United States Patent 12,673,078 (BACTERIOPHAGES PRODUCING HETEROLOGOUS BACTERIOCINS) - sequence listing, part 2

SEQ ID NO: 30 - DNA, 153624 bp, synthetic construct
  source 1..153624: mol_type = other DNA
atgcctaaactaaaacgtggtcgtggaagaccaacagccgaaatgcaacagatttacgcaatggatgcggcgcaagcaagtgtaaaagaattatttgcagagcattatttagaagctatgcggtatattgttgaacttgttaatgataaggatgcagcaaaacctctccgcttccaagcagctaaagctattaaagagcaagtagaagaatggttagaagaacattatgaagctatggaagaagaaactcctgccgtgcagaatacagatgacgttcctaaaaagatcgtaatctaatccctctcctctcttggggctttgcccctcctccttgttatttttaacacccctctccgaaaggttaggggcttttttatttttaatgcttgcaattgtatatcattttatgataagatcagatatgaggaggataaaatatgcgcaattttgtagttaaaaatgattttaaccgttcttcttatcataaagataaaaagaatgattacacacgggcttggaacttggaggaagaactttatgatgacagagaagacttgggaagagatcctagcggaggctcaaccaatggaagtgaagaagatagttaacaacgccccttctcttcctaaaataaaattttatgaggaagtagaagataatgaatctaaagactaaaactgtattaagttttgttttaattgttgttcttattcttgccggaatgtttgcttataacaagatacgtgagtctggctacaaagatggtgttgcctatcaaacgcaagtatatcaagcagcccaagcaaaagcaaaacaagattttgatgttcttcaaaaaagagcagatgaagaaagagcattattaaatactcaaataagcaacttgtctaaaaacaatgcacaattaaaagcagatttagagaagaagaaacaaacgatcaatgaggatacaacgaattatgcaaaaactaattctggcagtatgtcttgctttgcccctaatgatgacgggttgttcatcatcaacaaaagtttccccagttcttattgatgagtgtaaggctgtagccatagaaaaggttaaaggtccagattcggacttgatggataaagtatcgacacctgtgccatacactaaaaatcaaattgcaaaaggggttagtagatctgaagttgttaacaaccaaactcaaaacaatgctctttgggagcaagatagacgaaaggttttaggtttacaaacatatattaaaacactgcaagaaaaaggtattattgctgaataaggagggaatgtggcaaagaaaaaggcagcaggtagtttagctggagtagatattgaagtaaaggctcaaccaggtaaacagactcttgcaatggatttaatgccagaagttatgatttatggtggtgccgctggatgtgtttctgctgaaacggaatatcttacaaaagatggttggagacagattagtgaatattcgggagaagatatttaccaatacaaccctaagaataagcgtttagaattggtaacaccttactttgtagaatacgatttaaatggagataatctatacagaataacaaatggtgtaggattgttccaagaacttagtatggaacaccgttttgtattctataagaaaaagaaatcaaagaaacatttcgagattcttgtaggagatcttattgcattacagcaaataggaaaacccctgcaaggttatgtagaaaatccattcggtaaacgtgttccttttaacatacctggtaaaaagagcacttacttaaaaatacacgaggttatttcaacagatgataagaaatattgttttgagactccaagcagctatattgtctttagacgtggcgatcactgcttcgttactgggaatagcggcaagtctcgtctgctattgctgaaagctttaaaatacgcctacaaagaccctttgtttggtggaatacttttccgtaagaacaccactgctcaccgtaaaccaggtggtctgtttacagaagcaaaacgtttgtatcttcctttacaaccgcacgtaaaagaaagtacaatggatatcatttttgaagccactggtggtggaaccctcaaatttgaccatttggaaaatgataacgtaacagcagaaacaaaccatcagggtacacagtattcaatggtaggttttgacgagttaacccacttcacgcaatatgaaatgctctatcttctgggacgtatgcgttcagaatcagaaacaagcttcatgttgtgcacatgtaaccccgatgcagatagttgggttttgaattgggtattaccttatctcgatgagggtggttatcctagagaagatatgtgtggtaaacaaaaatatttcatcattgttaacgatgaacctgtttttgctgatacacctgaagaactgaaagaaaaatatccagaaaactgtttcatggaaaaccctaatacaggggagacagttgttattgaaccacaaactttcgtatttatcggtgggacaatatttgataacccagaattgattaggcttaaccctaattatttagcacagcttaaatctcaaacagcaatcaaaagagcacaactcttggacggctgttggtttgcacgtatacagaaagagtctttcttccaacgtgaatggttgcataagatatcttataaagatgttcctaataatcttaaactaatgcgagcatgggataaagctgtttcagttcctacagaaacttatcgttatccagactatacaacatctgtcaaaatgggtaaagaccaagatggtaatatctacatctttggtgactatgattatgatgctgtggatgagaaaagtaaaattttcggaaggtttcgaagattacctggggaaagggataacctgattctaaatcaatgtaagattgatggaccagaagttacagtagttcttcctaaagacccatctggtgctgggacaatagaatatacagagtctgcaaagaaacttattctagagggttttgttgttaaaccagatgctatgccaggcaacaagaaaaagcttcagcgttttatgccttttagtagtgcgtgtcaaaacggttttgtttatattgttgaagattctttccctaatgtggaaactttaacccacttttataaagaattggaatctttcaatggtgaaagatctacagccactattaaagatgacattcccgatgctgctgcttcttgtttcaatactctgtcaaaagagaatactttcaaagcagtagcaatccctgcaacaacaaatgctcctacaggatacagtagaatgaacagcggatttcaccaaccgtatagtgtccgtaaaagataattgttgacaaaagtcactttaaagtgtattataactagataggtgaggttgtatataatacagccttgccttaacgattttatacctgactggaggaacaagtgtcaacaggaaaaaaaacgtacactaaaaagtcagaatactgggacaaaggtgctgcaaataaagctgctctctctccaacaaaagaggcagagaaagagaaaacgttactcctgtcacctgaaataggaacgatcggattaaactcaatcaaagcatttacgaatttcatgcaaccttatgagactcgtttcccagaatgtattcgcacttttaaagagatgggtgaagaccctgatgtagctactgctcttgacgctacatatatctttgtagatagagcattctttgatttcaagataaaatacaatgtaaactcggcaaagtcaagaaaagctgctaagtttattgattacatgttacgcaatatgcaagcccctctacgtcaatatgttagatcacttttgacatataagcaatatggttttgcattcgcagagaaagtttatgagttggatgaagatcctaaaagtccttactttgggtattggagattgaccaaactggcttttagaccacaagacactcttcacatggctcaaccttttacatattcggcagacggacgttctattctatctgttaaccagaatatcaccaatacgatgttagctccaggtaatacaactttagaaactggtattaaagaaattcctttcagtaaagttttatttgttggtagcaacattacagagaataacccactaggagttagtccgcttttagctgtatatcgtagctggcgtgaaaaatctcttattcaggaatttgaggttattggggtatctaaagatttaggtggtatgccagttcttaaggttccaagtgacattctaaacagggcatctttagatcctgctggggatgaagcacaatctcttcgagttctccaagccaacatcgctaacctgcactctggtgagcaagcctacatggtattgccttcagacgtttatgaaggcacagtgatgcgtcaatacgatcttgtattccaaggtgttgatggcacgggtaaacagtttgacactcaagcactaatcaaacaacgcaaactggatatttataaccgctttggtgcaggtgtgttgattatgggtgatggtgatgcaggaagttttgcgctttctgacaacaaacaaacactattgtctcattttattgagcgagatgtagatattgttgtagaagctataaactctcaactgatccctcaaacactacgactaaacaatatcttcctttctgatgaagatatgcctaagtttgtcagtggtgaaatgggtgatcctgatattgaagtaaatgctaaagctattcagcaattggtggcctctggtgcaatacctttaaccccagaagttattaacgagttccttgaaaaaattggttttgaatatcgcatccctgatgatattgttgccaataaagagaaattctttgaattcatggataactatatgcctgacaaaacttcacgatcaggagatggtttagctacagcgggaactggaacgtctgatactgtttctgctttagatccttcagcacaaaacctgtcgaattaaaaatatttaatattttttaatttttctattgacaaaacaacaaatatcctgtagactaagatttatgggatatctgtttttaagaggtttcaaatggaactcaataaagatacactgtgggaactcttcaaaacctttgctggttttaaagagaattctgaatcccaacaagattctataccatctcaaaaacctgaaactttaatcaaacaaaataaatttgatgaagaaaagatgcaggttattgaggtcttgtattgtccacctgaagaagacgatctccacggagagcgaatgtctgatttggaaatcaggaagatggttgacaacttcaatgagaacattaccaatattagtggtaatcttggtcacatgaagaacaccgataagttttctccaattaaagcttgggtaaatgaagtcgattgttacattggtgacgaactcgttgtggaaggaactcccctcgttaaaatccaattcaacgaccctgaattatatcaagctcgtaaagacggcgttcttaaaggtttgagtataggcgcaatgggcgttaaagtcaagaaggactaatcgtggcaaatacatatttaactaacgtagacttttcaggaaaagctacggaagagtcactaggtgcgcatattgcttacacttttgattttcaaggtggagcagcatctggttataatactccccttttatttaagtcagacggatctccagacataacttttgaaaagttagaagctctcactaaaatgggagaagatgttacagagttacgtaaaagctatattcaacaagtaatggatcgcatttctgaaaaagtgcgtgaaaaatttgaagctggttgggattgggtttacgttattgatgctgacttcgatgcgaacgttgcaattttctgttcagataatggtatgttctctgttggctttaaagttgacggactgaatgttgaagttgaagaggttgctaaacctgttgttcgtgttactgattatcaagttgttgatggtgatgtaatgatctccattgatttctttgaggacgttttagacgatgctttgagtaatctcgttaagagttccttgaaacaaagtcaagttaaagattatttagtgaaagctcacgctaaagctaatacaaactctgtggatgcagaggctaaccccgcaggtgataaatctgcaaacacaactggaatcaataaaggagaaacccctttggaaaatatcaacaaagaagaattcctgaaatctgctgaattccaagaactgatgaaagcacagatcgctgaagctgtagaaaaagcagccgcagatgcacgtgcagccgcagaacttgaagcacaggaaaaaatcgctaaggcagaacaggaagcagaagaacttcgtaaagctgaacaagctcgtatcgaagaagaatatacaactgttgttaaatcctattctttcgtagaagaagacaaagttgaagctctcgttaaatatctggtagataataaagatatcgctgaaactatcgtcaaagcattcgaaaaagcacgtgcagaagtggacgcagttaagaaagaatttggagcagaacgtggtgttgatgtgatcaatactcaacctgtagctaaatcttcttctgaactgattagtcagaaagctgctgaacttaaaaaagcccagaaacaataatcttaggagattaaattaaatggctaaaggaattactttatctaactctcgccaggaattcggacacctggttctgggtggagtgtttagctctgaccttggacactgtgtacgtgaagttaacctggttaaaacagcaaccatgaaaattggttctatcctgaaagctgacaacactgaagctgctaaagctgaagctgccgatgctgctaaagttctgatttggactgatgctctgttcggtattgatgatgtagcagtaggtgacactttcaccgcagttgttggcgtacgtgatcttactctgaaccgctttgcagtatactacaaagatggctccctggtagatgacgctggcgtagcagcacttgaaacacatgatctgaaactgactgaaaaagtcgttttcacttcttaattttaataggagattaatataatgccagcagtaattttagatcaggttgtagatttcagtcctatgatcgaacttcaggattcccctgatacactgattgccagcctgaatctgttcagcgttgactatcattcaactaccgctattgaaatcggtaaagaaaaagctgaagatgcgctgatctccgctcgtgagcgtggtggtgagcgtaacttcctgaccatgaaaaatccagaactgaaagcgttccgtattccgttcttccctctggataaaaacatcaaagctcaagatattcaatctttccgtagctttgcgatggcaggaatcaatgactctctgcgcacagacgctgaagttgttaaccgctatatgtcccagattctgcgtgacgtagcaaaaaccaaagagaaaatctttgcagaagcagttatgggtcgtgcctataacggcgtaggtggtgcagctaactctgcatacaactggtataccgagtggaatgctacccagaaatctgttgctgtagactttgcttctaccactgtttctccagcagccactatcgagcaagaagctcgtgcttacatcatcgatactaaacaagatggctctaccgctactcgtatcgtagctctgtgttctcgtgaatttttcgcatctctggttaactctccgtttgttcgccaggcatatcagtatttccagggaacccctaaccttctgcgtgaccgccttagcggtaacatggatgttcaggtgttcgaatggaacggtgtaacttacattgaagatatccacggtaacatccctgctggtgaagcatatgttctgcctatgggtatcgaaggtatgttccaggcgcactacgctcctgcggatactccagaactggctaacacccaggctcgtgaactgtataccttcatgatcagccagcatcgcaccattcagcttcagtctgaattctcgctgctcgcagttaacacccgtccagaactggtagttaaactgactactgcttaatagaactctgttaatattagaggctcgtccgtgatgggcgagccttttctgtttacaataagagtttacaatgaagagattgatatgtcaaatccagaattgaaacgttactttagttatcacgaaatgattcgtgatttcgaatcgctttcaccactgatcgatgctgataaaacattagtatctgcgccaccaatgtctttctatctgaaagatggtcgtattgcattaggtggaaacttcattcacttcctcacacgtttgagagaagaaacaggtattcttgtgcatccttttgcaagtgaagaacacatgggttactatcttgtaagttacgaagattatacacctgtaaaaatcaaagaagaagttttaaaagtagaagcggtagacactccagctaaaaaacgttcccttcgtaaaaaataaggtgggcttatgctgaatgcggtagagttggcaccactgatccgaattcttgtttataacccttctcaagaagtattgccagatgcaatgctgattcagatcatccagacttggattgatattatagggaatgaagataaggacaagtgtgcagtattgtggaacagtttgatttctgttttagagtatttatggaacaacgatgttcttaataacaatactcaaacaggaggagctatgtcccgcagagaaaagatgggtgaagtcgaagttgaagttaaatttaacaacggtcaagtaacttataagtctccgtgggaagatatttatcataactatttaaatggtcttatggttattcctgggtgcacggcaggacgaggagcaaccagtaaagttcttattggtggtgttgatgctcgtgagattgatcgagtaaacagcgatcctaactctgtaaatggtcttggtaatgttgcaagtgttgatcgtaatacacgcaacgttaattatttgcgaaattatggacctgtttctttttatcgtagggacaaataatggaaagtgagatcttaccaggtgatgatacggattggcaaaccattatcaaaaagatgatggaccttgaacaagttcaaatcgaagctggttttttaacaaacaaaaggcatcctgaatcagatctcactattcctgcaatagcagctattcaacaatatggtaatgaaacaaataacatacctgctcgcccttttataacagatggtgctgttatctcacagaacaatatcgctaaaaagatgaagcaggtgtttgcaaattacttaatgaataatgtcgggttagctgtttttgagcctatagcgagagcctctagagaaggaatagctcaagcgattgcaatgcaacgttatcgtcctttatctcctgtgacaattaagatacgacaagataaaggcaactattctaatcatatcttaatagatactgcatacatgataaatgcaatcgaaacaaaaatcacaaaaagcaagtctaaaaaataaagtacgaggaggtaaatatatatggataaagtcactgataattctccagatgtggagagcacagaatctactgaggggtcattcccaactgttggggttgatactggcgatacgattacagcgacgcttgcaactggaactgaaaatgttggtggaggcggtggagcatttggtggggccagtgaaagttctgctgcgatacatgcaaccgctaaatggtctaccgcgcagttgaaaaaacatcaggctgaacaggctgcccgtgctgctgcggctgaggcagcattggcaaaagcgaaatctcagcgtgatgccctgactcaacgtctcaaggatattgttaatgacgctttacgtgctaatgccgctcgtagtccatcagtaactgaccttgctcatgccaataatatggcaatgcaggcagaggctgagcgtttgcgccttgcgaaggcagagcaaaaagcccgtgaagaagctgaagcagcagaaaaagcgctccgggaagcagaacgccaacgtgatgagattgcccgccaacaggctgaaaccgcgcatttgttagcaatggcggaggcagcagaggctgagaaaaatcgacaggattctcttgatgaagagcatcgggctgtggaagtggcagagaagaagctggctgaggctaaagctgaactggcgaaggccgaaagcgatgtacagagtaagcaagcgattgtttccagagttgcaggggagcttgaaaacgctcaaaaaagtgttgatgtgaaggttaccggatttcctggatggcgtgatgttcagaaaaaactggagagacaattgcaggataagaagaatgaatattcgtcagtgacgaatgctcttaattctgctgttagcattagagatgctaaaaaaacagatgttcagaatgctgagataaaattaaaagaagctaaggatgctcttgagaagagtcaggtaaaagactctgttgatactatggttgggttttatcaatatataaccgaacaatatggggaaaaatattccagaatagctcaggatttagctgaaaaggcgaagggtagtaaatttagtagtgttgatgaagctcttgctgcatttgaaaagtataaaaatgtactggataagaaaatcagtaaggttgatcgggatgctatttttaatgcgttagagtctgttaattatgatgagttatctaagaatttaacgaagatatcaaagtcgcttaaaatcactagtcgagtatcttttctatatgatgttggttctgattttaaaaatgcaatagaaactggtaactggcgacctttgtttgtcacgctggagaaaagtgcggtcgatgtaggtgtggcaaaaattgtggcattaatgtttagttttattgttggtgtgcctcttggtttctgggggattgcaattgtcacaggtattgtttcttcttacataggggatgatgagttgaacaaacttaatgagttgttagggatttaacttgcataaactttgtttttgatgtatactaaaaaggagatacaagtgttactagatcaatttactcttcttgatctaactgaataccaaggtcgtagacgaatctacaaagaggcagttgattcagttattgctaacttagacagtagtgtagaatatgaaccatttactattgaagcggcaagcttacaaccgatatctggtaaaacactgaatgcactacctgaaggttacagatctaaggctcaatatagtttctggactaaaacagaaatgaagggattacaacaaggaacagaacagttatcagatcagatactgatagatggtaaatggtattctgtttattcccttaaagattggaccagaacatctttcttagtccatcatcactgtgttgcaatattagacgatcaaaacaactcctggtcttatggaacagaaggaggaaactttggctaatatttaccaacaaatagaagcatacgaaaatgccatctacttaaatataggtggcttccttcaagaattagtggggttgccagtctatgttatggataagccattcattaaaccggatactccttacctagcactacgtattatcacttccagcgattctggaggttggtcttaccgaagctctattcaaaatgatatgtattcctacgagatggataatacctacgagattgaacttgtagcctatcgtggaagacctaccactttgatgagctatgttctggctgctctccgtggtgcagaggaattaaaatacaaacatctctattctaaaggtcttggttttttaggagcctctaatatagctcaagccaatacgattgtagacggagataagactgaattaagagcgcgtatggttatgacgttcaacactcgtatgagtattgaagatattgctactacaccaatagaagcaatcaacatgcacatccgttcattcagagatagttacaatgatcctatccctttagatttaattctaaacagggtttatgcaattactttggttccaggcgaatactcgtcagttaatcaaaatggatcattatttaacaaccctaccgaataaactcattggaattaagtttctaacaggagcataaatggcaacttttcgtgaaaaggtagcaaccgtaactttactgtatggtgctacatcaattcgtgaaacccagttcgatattcctctgatccttacaggtcagaacgtaactggcgaagcgattcaatattactcttcttccgatgcacttttggaagcaggttatggattaaatgatccagcgtatattatggcagtcaaactgtttaacggtttgttcccaccagatcaagtcatggttggtaagcgtgaagttacaaactttactctaactccaatcgtagaagatagtgcaacttacacaattaccatcaaaaatggtaccaagaaaaaagaatttaaattcattgctgatgacactgcaactgcacaagagattgtagttggtctgactgaaatgatcaatgcagatcttgtttatggcccactgtttacagtagctaacaacggcgctgcaatgactttcactccagtagaaggtaagtttggttctattgacagcacaggtttcactcaagaaactgtctatgctaatgctattacggaagatatcgctgctctgcatgatattgatagtagctggttctggaccctttcagattcccatgaaacagaagatgttctagctttggctgcatgggtagaagagaatgataaagtttacttcttctctagctctgaacctggaattaaaacgaaagcagaagataacgttctggaacgactgaatgatctcggttataataacacttgctttgctttgtggatgaccgatgcagattctgtattcccagaagcagcagttgttggtgcaatctgttctcgtcaacctggtttaactactcttcacggtaaaacactagtaggtgtagagatcgagaaactggatcagacttcggaaaacaatattgttcaacagaacggtaacatctatcgtaaagagcatggaactctgttctatcgtgatggattgatggttagcggtttctttgttgactatgttgttcatgctttgtggtttaaagctcgcacagaagaatcactgtttacactgtttaaacaacagtctatgctgggtggtggtgttcgtgctacttcaaacggtctggctttgattcgacaagctgttctggctaacccgatccaagtaggtatcctcaacggttccatcgctaatgaagttgttacttctgaagagactggtttgcgtgtcgatctgaaacctattgtttatattccttctcgtgccgatatgaccgatgcgcaaatcaatgctcgtctggttgatgggatgaagattgaatatgtttacgctggcttcttccattacgttaaagttcaggtcaacgtcctgactaaccgtactgcaaactaatacggcgggggttaagcccccgttatcaaaataaagaggatctataatggataaaatgcttactggcgtaatggcctacgacccatctcaagttatcctttcattaggtggttgggaaccgtggggttttgcggctgatactaaaatcgttattgctaaatctaacgatattatcaacccttattcagggactgatggggacgtttcattagctttgagtcgtaaccgtttgggaacactcacaatgtctttgcaacgcacatctccagctaacgaagtacttgcaacatatgcacaaacaatgtattctactcgtcaagtagcattcagtgtttacttggaagacccacgtggctattacattagcacgattggatggattcaaagtcagcctgaagatactattggcgaaatgattacagagaaccaatgggttattggtcttaaagatgcaagccttctgcgtaatgaagttggtgtaggtttgagcacccttaactcaatctctgctctgacaattcaataataaataaagggcagaaatgccctttttatcattagagaggaaaatatgtcacaagaacaagataacacaattcaaaaatatgctcgaccagaagaagtagttgagattccgttggatggaaacagatctgttactttccgtattatgaagtggagtccatctaaagtgtttgacaggattccagaattaggtagtgttctggttgttcctatgactatgtatagcacagcaacaatgtccgcagacgaagaccttgagtcacgtattgctatggcactgatccaactttttgcaggtttggaagaaaagaatttaactgtctttttgcgtaaaattttagatgaggtttatactcaagacggttataacgttgcagaaaattttgatgaattatttatggctcacccagaactagtgttagatcttactgctaaagttctggaggtaaactacggcccttttttcaaacgaggtttcggaaaactgttcacacagcttcaggcgatgacgagtttagcagcaaattaacacctgcgattgaacatgctatcgacacagcaacgaaaacccttactttgaagtggtatgaggttattctttgcaaagtcgttaaagatacctcggaaacactgaaaacattagataactacggtgtagattatcttttaaaactatatgagtatttaacatacgaagagtatgttgaagccatgtatgttaaagacacttcaataaagagaaaacatcaaaaccagacaaataaaatgtcagatttgtttaagaaacttgtttaatccaacacgaggaacatactttgttagaaattaacgcctccagaattagtaacgtggttacgtttaaggtggacaagaacagtctcaaggaagcaaaagatgccgtgttgagtgttcagaagtttgcaaataaaatgcaacccactatgaacatgaccaagtttagacaacaaatgaaagagattgagcgtgaacttaagaaagctcaaactcaaagccaaaaacctatgcgagcacctactcccgctggagcgggtgctcctgtaggtggttctggtagacctagaactcctaaaaccccacaaggtagagaagaagaaaaagctcgtaaagcggctgaacgagaagctaaagcagcagcacgtagggaagacttaggtaatcttcgtttacagaactttaactaccgagcaagagcatttagtaaagcaagtcctggtgctatgcaagaagctagagacgttatgggtaaagctgtagagcaatacaaaaagggtgaaataactcttcaacgtatgaaccaagctcttgctcaccagttggatgctttacgcagatctcatcgtgaaaagaatgctgaaatagaagacgaggttcgcggtcgtcgccgtattcgtagagagctagaagcagaagctaaaatgcgtatacgtatgcgaaatcgtgaacttagagatatagaacgcaaccgtaagcgtgaattagctcaacaaaaacgtgatcgtgatcgtagatacggacaattaaaagaaggtgcagcaggtcttaatccacgtatgattgcatcctctttgataggtgctggtctgtttgcagggggttctgtagttggtaacacgttgatgaatactaacgaaagaattaaacttgtaagccgtggtgctgaaaacgttcagacaaacgccaacgctattttggcaatgacagcttggggtgaacagaacggtgtagactctgcaaatattattaaatcaatagataatattaaagacgttcgtgaacgtcttggtaataccgttttagctgcaaagtggaatgagaaagaagggaagtggaaaggcggtgataatggcataaatgacattatgaacttgttcggatggaatccagaacagcttaaacctttacagaacgatcctttagcttttattcaggctactgttaatgaaggtgagcgtcgaggtatgaactctgctcaaatcgggcgacttcttgaaaaccttggtgatgaccttatgcactaccaacgtatgtttagtaaaaacggcgaagggtataatgaagtattgaaaatgcttcaaagaacaggtgcaacattaactcaagaacaaatagatgcttctaaagagtttactcgttttgctgcaacagttcagcttgtaggtcaaggtatgcagaaccacttcttagagggttttgtgaaagccttacctaaagatgattcttggttggataacgttaaagtgctagatcagtttgccaaagatttaggtgaagaactcggtaagacaacagttcaattaggaggttttgctaaagaattgggagatggtttcggatcttttaccaattggcttaaagaaacattcccagataccttcggagacaacacagatcctaataaatctatggcacaaaaagcatacgaggcaacgcaaagtggagacagcaatcctgtagcagattggttgtacaatttaacaggtattgatacacaagatattggtcgtatgtggagaggagaacaaacaaggacacgtgcttttggatttggtaatcctcttgaagatttacgtgaatcagcctatacacctaacgtaagtttggctcgtaatcaacctgttgttgagaatacggtagcaataccaagtgatcttatcaaagttacgatcagcccttcttcagagtttggaaatattcttgatgcaagaattcaaaatagcggaaatagcattttccaacgtttgtctctttcaactctaagtggacaatctaacactggtggttaataaaatacctcgcttcggcggggttttttcgtttcccttgacacgaagtttctatatgtgttacaataatcaatatgggaagatcttgcatcttccttttggcattatcattactacgaggttatcatggcagcaatgactccacaacagtcggtgagagccgtctataaggcagaacaggaaatcaactctaccgagaataaaaatacctcggcatctactgtaaagggtgataatggtttctgcattttagcaagtgtttataatagttcaagtgatcaatacattcaaaactttaaagcaattactttcgattcggtccctgaagtaggtgtaactcgtgaggcagatgttacaagttttccagtagaatcaggatcggatgtaagtgaccacgttcaaataaaaaacaacagatttaaactttcaggtataatcaccgaaacaccaattcggcttatgcgagatcaattatacagtgcaggtgtaaatggggcaaggatttctcaagcaatagaatatctagatcaaatatttgagtcaagacaaccaatagttcttttgacagaacacaggacttttgaaaatgttattctgaaaggctactcttatgattataaatctgaatttgctatgcaatttgatttagagttcgaacaaattcgtctagtctctaaggccactactaacgctattgctgtaaaaacagcaccaaataagtcaactggtggtgatgtgaaaggtcaagtcgcttctaatggtcctaagtcagatattacagtaagaactgctgaagctactaataccccaacaaacaacggaggttaatagtgacaacttattctaaaacaacaaggtctacaagtaatactggctacagtgcagtttatctggaggaccattctacttattttgcatggtatctgaaaactgaagagtaccctgatcaaacatatacagttacattggatggagttgattatgacattcgtttaaggtggaacactagggacgagtcttggcaatgccagataggattatctggagatgatccaagtataagtttcaaagttacaaatggtttagatcttcttaaaccttataaatatcttgaaagtgtgccggatggtcaattgtatatagtagatacagttaagattaatggtcgtcctgggtatacaactacaggtcgagataaacgttttgtattggtttatattgataacaaacctaatcaggcgtaaggagataatatggcagaaagagagtatacaaaagctcctgcccctaatttaaacagggcatacaaattattaattggttctgccacaaacacaatacagaagagaactaagaactcggcatttaaatctacagtagatttggataccaagttagggacaacagaaaaatcctcttctaatttgtatttgttgcaagaccatcaaataaccttcagtattaagaaagataataacaaagatcctaaccaagcagagattgtagtttataacctttcggatgatactgttaactatataaaccgtggtatccgaaataacttggctgttgctttagcggtaggatacgaaggtgaagagttggttatggtcttcaaaggaactatccagtgggttagtgatacttttgactcggtagacaggaaaaccactttacactgtttggatggcggtattaacattgcagaagcaagaacaagccgcagttatccaaaaggaactaaaatcaaacgtgttgttacagatttggtaaaggatttaggaactacagaaggtaatatacacgtagataatgatcaaaccttatcttcagcaacagctatgtgtggaaacacttcacattacctagaacatatttgtaaaagtattgatcacaatgtgtcaatacaagatggatctgtttatgtcactcctcgttcacaaatgtctagtgcacgtagcgcctatattagtcctgaaactggtctgataggaagtccagaaccattccacaacgatataaaacctactaaaaaagttaccaagtcctctaagaaggcaaagaaacctacagacggtgttaaattcaaatgccaaatgaatggtgcaatattaccagaaaaaacaatctggttaaaaagccgagattatgatggtccatttaaagttgtttctgtttctcacaatggtgataaagagggtaaagagtgggttactgaagtggagtgtgtatccgtgtctgaaataatgactaaggagaaataatggatgcattgaattttgtcacagcaatgcgtggcttaatgacagagcaattagcagaagtccatacagccttgccagtccgtgtgactggcgttaattatggtgctaaaactgtcactttagaatctattgttaaaaacacacgatctagtgaagatgaaatagattatcctacttttgaagacgttccttttatggttaatggtggtgggacaggaagaatctcattccctattaaagctggcgatttaggaactgttatattttctgaaagagatccttctaatgcactgcaaactagtggggaaacctcttcgtcatccacttttatgcagccttgtggattataccctatttgttttattcccaaaatagctacaggaacagattcaacagaagctgtagattctgaaaaggtagttatttctaataacaaaaacacgtacgcttctttcgaccctacaggtaatatttcaatatggaatagtcaagggatgaaaatagatattactacctccggtattactattacagatggcacagggactttggatctaaaaggtggtaatttaactttcaaaggcggcgtagcagatattaatggtcttaaaatagatcagaacggtttgatgacagatggtaatggcatcggattccatactcacacgcacacggttcgtaacattcagagcggtaactcaagtgccgagtccttaaaaccaacaggagcctaacatgggaatcccttttgacttaaaacttgggccaaacaacgacctcatcatggatgatggagatttggtcctcactacaaccagaacagaaattgcagcacaaactcttgggataactctgaacacgtatcgtggggagtggtttttaaatactaacttcggtgttccttacttacaagagattattggtgttgctagaaagaaagatattgtagacagaatatttttagcagagattgccaaaaacgtttacatagatacaataaacagttataaatctgcttatgacatggatcaacgttattactcaatgacagttatggtcacagtaggagcagatacagtaacatctatattcaatactcaaccttctgaagagtttatttaccctgaagctggtgaagacaatgcagcgatcatttgtgaagcttacagtattgttgagaattcgaatagactttatcgctttatcaactttgttggtttgccacgtgatacctactctacttggtggaatgaatggtctacagagtcagcagtggaaagaatcatggttaacgaaaaaggtgatgcattagctacaaacaataatttcggtataacagctatgacaggagtagaagagtaatggcagatttaactacgatcaaaatttctgatcttacacaaacaacctctgtgtctgatacagatttctttgtaacagatcaggctggaataacaaagaaaacttctttgaaagtgttgttgaatggtgcaggggtaactagaaaccgtctgaatgcacggggaacagtaactagtaccttggcattagatattagttcagcagaatatttttcggcaaccttatcttctgcaacgtgcacaattagttttactaatattccagtagcaacgaatgcagttttaaactttactttatctttgcgtcaaggaagtggcgcaaataaagtcgtatggccttcttctgtaaaatggagttttggtcgttccccagttttgagttatcgtcaaggtgcaacagacacttttgagtttatcagttatgataatggtgcaacttggacaggtagcttagttttagcaggagttatttaatgtcaagagttaagcacaatattgacaacacgtttcagttgattgaagggttggttcagtttttggaaagaaatactgggcttaccatagatcctacggttcagcactacattatcaacccacaaaacgtattggcgaacaacagacactttattaactggacagcgcaggaagggcaaccaaacggtgacgctactaccgaaggtcaatctgtgcttatcactggttttgcttatgcatatttggctacaggggataaaaaatatctcgaatctgccgagaagtattggcaagcctatatagatcacttcttcgggggccaacctattcctgatcctccggctaaatatcgtcccaattggatcatcaatggtaaagaaccacgtttagcacattaccctctcacagacgatgggtatcctacgcacggtgggttcaaaggtagcatgatgacttggattaacggaagaactgttattcctaaaggtgcgccacattggggagaatatttagataaagcttggtttgctttcaatggcaatcttggttggaactccgttaacgcaacagtttatgcaattaacccagacggttcaaccaactggaaagaatatggagatcagtgggacgttgaatggattatagatcgtctaggacgtaaagttgattgggatggtaacattttatctacaggtcacagctttgcagaatatggaacagtgcaacttaaaaatgcttctgtgaacggggattataaattcaactatgctacatgcaaccctgtagaacacggtggatatctgcttaagcgtaatgagatgtggcataaccgtcctgtaaacgttccggtagagttaggttatcaagataatgcttccgatgctgaaacgtggtggtgcgatgcaaactacttgatgtatcagatcacaggggagagaaaatattggctttgctggcaatcttctttattgctgtgtcaagactactcaaacattgatatgtttgataaattcttccgtagatctacgacagcaataattccttttacagatggtatatcttatgattactcatatccatctacagcaatacctaaatactctcgtgacgaattaggatacacagtaattcgccaagatgttgcagcacaaacaactttagaacaacaggcagtttggttcagagtggatcagaattcaaaactgcgtattgagttccaaggcgtagatgatgcaggggaaggtattcttttccgtccagagttagaattaagcaagactaagagtgaaacagacacagtgacatatcgttgtggcttacctcttggtgcagctaatgtgactaagatggatatacctttatccagttttatgcgcaccgaacctcctggaggtggtgtatatattattgctgaacctagaatcattgttgactggggaagcaatactgtgatacaatataaatatgcaactggtattgctgggacaaatagtgatcagatagtttctgctaatatggattcagatggtggttttactgttgggttttggttaacaccaactaaaacagccaatttaaaatctattacgtatcgttcatacgcagatgattttaacatcactattacggattccgcaggttggagatggtgggccatgttagaaaaaacaaattctacatgggttactaaagctttaagtcctgctgatttcaaattaagtacttggcaacctaatcacgatgacacagagacaaaaccttcgtcaataaacctgactgctattgatcagatcaatattgcattggattctgaacctgcaaatggcttgacaggggcaatcgatttttattgcgttaacgatatcccatctttgtattcttcagccactggtgatgattacacaatgtatttcagggttacagtttcatctgaaaatccttatacagcaaaacttggagattgtacaatactggactacaaacttgacagtttgaattatactccaggaatcattccattttctaatattagtgatcctaacacagcattatatgacggttggcgcggtattccttacccaggttatcaatacccatccttatattgttttaaagggagagatattgattgggttcgtatgaacaacagtatagactttttatatgattcacaaatgtggttttataataagtttgcccctgtgatgcctgggccaatggcacaagcttatgtttgggatcgttgggatgctcataaatacggaaacaagaatgagttcacaatgtatcattggaacgataaagcttgggatgggtatgaagcacgagcattcttctgtgcgtgtcatacagtatacgaacttaaacaacgaggagcagaagttcctgaaaaacttttaacagtttgtaaaaactggatcaactatctgaagtggttccaagacaacaacgaaggaagaacaccaacaatattttatcccaatggagaagtggcagcgcctgtagatgactttacaagtcacatgtctgcgctatttatggcaggatgtgctataatggggatggctggatatgattcagaaattcctaacattaaaatagtagcagaccgctgttttgaacttattcaggaaaattatattgttcttggtcctaatcatgttatgaatggctgttggagttccgctcctagaccagatagtgataacggagtcttctttggcttccacgctggagagttgttacgtggttttgggttgtatgctttatacaaaaaacttaatcctcaaaatgcattacctgttttggattcgagcaatattcctgcacttactgttttgacaatggcaaacattagtgttgacgttaccgagtaaggggtaaaatgaaacaagctatatttactgtcacgcgagacaagagagtaaatgcgagttcatttaactacacgactgttgatggaacagcagtcgctggtagagattatattgcaaaatcaggaacacttgtgttccctgatgatgctgattctgctaccattgtggttgaagtatttgaacgaccaaagaactcaatagatcttaacttctccctccaagtttcagggattagtcaaaataatatgatggttgaaacgaccatcaactgtattataactacgattcaagaaaatactactccaataacttggactacaaaagacgttaaaatgttctctcctatgtattggacaatagattctcaagcaacggaaagttgttctattgtatctcatggagactcttttactgcaagatttgtaaacagaacaacagcaggtttggcaggggttatctggagcacagttgacaaatatgaccataaaggtgttgggtatttaccccacacagatttaagttcagagaaactttggtttaaaatggaagttagtcaaaacatgccaggttttaaagaagaacctttggtgccaactttgactgtaactctcttggataaaagtgtccactatgttagtttaggattttatgcttcagatatttcagaagatggtaaaacagctacaatcaaactagattttggtaatatcttctctggtcctaataatgatattcctttggacatgagtgctgtagataatattttcttctctttgattacagcaaggtatgaagaaatagaagagattgtacctattgatagtcaagaggcttggtttactttcactcttcttgaacctacttctggttatagtatgatgaaagtcagtaaccttgtccagcctgaacatgatattcgcatgtgcacatcttatgacgatatgtataacctgactccagagagagttatttataatacatatgcgctaggttatcgtggaatgattaaccattacaacggaatgtctcactattatgagttctcatggaacggaacatcttgggctttaaatagatctgtcttcctaaatccagctacagaagcttggctaaatagtttccattctatagcgaacgagaagggttacacaataatgaactctttaagttttgagttgatgagcacagtttgtcctgtagaatgggtccagcatgattggaacgatgctcttgcagcaacagggtatgagcctcctagttacgtgttgtctccaactattgacgaaggtatgaaatatttgcaaaatgttattaataaaatagcatctatttcgcaagctaataatattccagttgtcattcaaattggtgagccttggtggtggtataatacagcgagtaaaatgccttgtatatacgattacactactaaactagcattcaacacagaaacaggtttatttgcacaagatgtaggaacaatagataattataaaacaggaacaccgtttgacgaatactatgcatttttgtctcgtaaactaggattaagagttgcaaagtttgcaacagatactagattagcctatcctggagctaaagttacattattaccatttgtgccatccattttaggtaacggtatgatggagtttgttaacttccctaaagattattatatcccagaaaacttcgacttttattgttcagagtgttatgactggttgttggaaggtaagatggaaaaatcttttgacgctatcacaatacctaatgaacaattaggttttagttatgataagatacattatcttgcaggttttgttccagatgctactcttgcacctttgtatggctttgatcctgaatcaaactaccgcacgtatctttggaaaatgattataggtaacatagtgttgaacgccaataagttcaatggccttacacaatatatatgggcctatcctcaaataatgcacgattctatcacggtagttaattctcaatcccaagttttctatatgggtaacgtgcctttgaacgtttatttacaggatatcactcttaaacaggtaaatgttgagattgccaccataagtggaattacattagccactaaatctggagaagatttagtaacaacacaaaaattttatatataggagtaaaaatgtcaactacaattactaatttacccgaaacatcaaaagttaatggttctgattacctggttttagaccaacctgataagactgttaaaagcacagtttccaactttcttactgacactggggtggttttagccacccagttaaaagatatttctggagctaccaagtacccagaacttcaaatgtcacgctggagagatgaaggtgatcctagaggatggggagcagtaggtgacggagcaacagacgataccaatgccataacacagcttcttgctgctatgcctgatggatggattattgatgggcgtaatctcactttcaaggttacaacactaccagatataagcaagtttaaaaacgctgcttttgtttacgagcgtattgttggacaaccccttacttatgtatctgaaggtttcttcgatggaaatctgacaaagattacggatacaccattttacaatgcttggacgcaagataagacgtttgtttatgacaatgttatatatgcaccatttatggctggcgaacgtcatggtgtacaaaacctccatgtagcgtgggttaaatcaggagatgatggacaaacttggtctatgccagaatggttaactccaattcatcctgattataatgcctcttcagcaaacaaagttaactatcattgcatgagtatgggtgtatgtggtaatcgcctatatgcagtcatcgaaacccgttacttatctaacatgcgattgaagaaagcagaactttggtcacgtccaatgccttattatagaaggccaactggaggtataacaattagttctgggtctactacggcgacgattgttttagaaaagcatggtcttaaagttggagatgctgttaacttttccaattcaggtgcaactggtgtatctggaaatatgactgttgcatctgtaattaacaaggatacatttactgttacattagcgagtgctgccacatctaatatagataatacaggaactacttggcattttggaacacgtttctgggatagcccttgggaaattacagaattaccagatgttgcctattctactaatgcagacttatgtgttacagaaacccatagttttacagttatagatgatgataattacacttttgctgtgggttatcacaatggtgatgtttccccaagaagattaggtattttgtatttcaataatgcttactctgacccaagttcttttactcgtagaacgattagtcaagaatatgctgacaatgcagcagaaccctgcattaaatattatgatggaattttatatttaactactaggggtacttcaacttctgttgctggttctacattagcaatgagtgctgaccttggagaaaactggaattacttaagatttcctaacaacgttcatcatacaaacctaccatttgcaaaagttggcaactacctttatatctttggtacagaacgttcatttggagaatgggaaggagaagaactagataatagatataaaggtacgtatcctcgaacgtttatgtgcaagattaatgtatctgtatggcctgcatctttatccgatgttcaatggtttaatatcactgatcagatgtatcaagggcatattgttaattctgcatgtggtgttggttcggtatgtgttaaagatggttggttatattatatctttggaggcgaagatttcttatctccttggtctattggggataatagtaaaaaattatggtacaagcatgatggtcatccagccgatttatatagctatagactaaagattaccgaacatgattttgtatcacgtgatttcaaatatggagctacgccaaaccgtacattgcctgtatctatgggtacggatggggtaaggcatgtctcagcccctgtaacttttgataatgatgtgcaaatacactctttaacagttactggtcttgagcatgatgggacacaacaatctgccgttagaataaaattagatggtgattatggggttgttgcaaaaaatgtcccaataaaaaatccttctgaacagcgactaatcttatgtggaggagaaactccttacgttactgatggatcgctattacaactatatggttcaaaccatacgtatccaaacagagcagttttatatgccccaggaggagcatatacccaaaataatttcatgccatatttagatggacaagttgcattaggtggtgcatctaacagatggtcagaagtgtacgcatctacaggaaccattaatacttcagatggaacattaaaaactaaacctacagagattgaagatattttactgaaagcgtgggaagatattcatgtaatctcttaccaatggctgagtgctatcgcggagaaaggagattctgcgcgtattcattttggtgttatagctcaagatgtaagagatattctgattaattatggtttaatggatgaaaatagcactgattgtaagtatgcttttctgtgttatgatgaataccctgctatgtacgatagtgttgttacaggacaaaaagaaatccctttatttgatgatgaagggaatgttgtaattgatgaagaaggtaatccagtaacaatcgtagaagatgttgtagaaactatcgaaataattccagcaggatcgcgatggggtattcgcgctgaccaaatgttttttattgagatggcttatcaacgtaaaaagttaaaagctcttgaagaaagacttgcaacccttgaaagtaaataataccgcttaggcggtatttcaatctttatatctcacttagaggtactcatggttaaagagaaaaacggttttaaaaaatttattcgcggaatgttctgcacttatcccggcaacggggtaagctctacgaaagtctggaacgctgtaggcatgtcggttatgacaggcatgtttatctttttaggaatagaaaaagaaattcctgaatggatgggttgggcttttgttttcatgataaccccttctcgcctcatgaaaaatcttattgatttacgttggggcagatcacaatctaccaaagaggatgactaatggacgaatatggtttgacagatgcgggatttgtaatcccgacttttgacgatgttttaaacaactacatgacagcagtaaaaaacacatttggtgcagatgcagccacttcggaagatactgtgatcggacaactgtttagaataattgcatacacagattacacattgtgggaaggtatgcaaggggtttataatactcaaacactggatggtgcagaaggtatttatcttgacgaaatcttttctaaacgtggtttctatcgagcaggggcagcagcaagcacaggttatgcatatgttaagagtaataacaaagcagcttggacttatgagctaggcacggatatttacttcaactctgatagcgatatgaactattatgttagcacaccaactatgttgaatgctaagattgcagcttatcaaatctctcgtgctaatgcaactgctacaggtgttccaaatattactttttatgcacaaagtgcggtggatggaggactaaacagtaaaacacttgcacctggttcttctacatttataaccgatcttgaaacttttatcaaggcgaatttaacagaagctgatcgtagtcttgtattttctgattcaggtaacttatcaattggttttacttctttaaccagtgatactccagtggggctggtaactcctattaaattttatgctagtgttccggttggaaccaagtggagtgagattccggtagttgcagcagagaaaggatacaatcctgttggtgtggagtctattacaggaatatcttctacctttacaggttatcttgacagcggtaacttctattcattttctcctggtcgagatgttgagacagacgcagaattccgctctcgtttcaatgacaatgttgatgaagctaacgcagggacacgagcagctattgtgaaagctctgctacttacagatggtgttactaaggtgaagatttacgataaccctacgttacatgatcaagaacatgctccggctatgactttccagactatagtttatggagggagtgctgaagaagttgctgaagttatttacaaaactaaaccaatcaacagtttgacacatggaacaaccaacataactgttacaacggaagacggaggacaagaaattattcgtttttctcctggtgcttctgctacgtattccgtaaaacttgtttatcaaactgtcaacggaacaactttaagtggaacagaaaaacaaaacattgtagaagctttacaaaacctgcaagcttattttgaattaggttcttcagtaacgaacgatcaaatcaaaggtgttatttatgcagcacttgcttttggacgcttgacttctcttcgtgtttatgttaaacttaatactgaggatgacagtaaatatacagagaataatatagttcctgcttataatgttgtcccttcttttgaccttgataacatttcttacgagtatggagtgtaaaaatggcagtgagtgttgaccatgtaacaacttgggccagtatcaatgaagacgttaaaaaccttctgattgaagattttaaatcttctcctaacattgtcaagctcctctacatcgtatccagtgaaaagcaaaagatagatcaggcaatgatctatcttgctaaacaccgcttgatctctacagccacaggcaaatacctagatattctaggggaagaaatggggatcgaacgtaatggctctgatgatgaagagtatagaacaatattaaaaatcagggcttaccgcgtagcctcatcggggactcgtggtgacataattgatatcttcgcccgtttcacaggaacagagcgtgaaacgcttaatacttacgtaggtttgaataaaacctttgatgtgtttttctacaacctgtgtcttcaatctgatcaagctttagagcagttgctaagtgttttccctattattagtagctaccgtcttggagcaaaagcaggatcagcttttggttttagttcttattatgctaccaaaccgcctcatggtattggtggtttaggttccctgtacatggaatctactggggatgaaacaggacgcatgtgtacgcttctcaagcaaatagattaaggagtttaaatggcgaagccaatatattatcctgactgggctacacaaactgtaacgctcccaggaactttaaacacaaacaaaattagacctaaagaaaccatccgcacagttggtatggattatggtcaaatcatgacttgcgaagaaatgaactggattcttaataatatcggtttatggattcgctatttggtggatgactttcttccaactttacctaatacctacttgcctttagtgggaactaagattacaatggcaggtgatgctactggtgaggctacttggaacggtaacaaagaagttactttatctatccaggttcaagataacagtcataatcacttgtcggcaaacattacggatgccactagttcaacagtaacaccaaacgtgttggtaaaacgtgatgcgggtggtgctatttatggtggtgatgtttatgttaacggtacttccacaacagatcctgcaacactgttcttcaaaaactttgcaggacaaacgaatggtgagatttctgccgagtatcaaagcggaggtcagctttacatctatcgtagaaatcctagcacaggtagtgtatcggcaggtgttcgtttatatgatgcaggttatgttctaatagataatccaagatcaaacagtggacaagacacttctaacggaaatgctttagttcgtttagattatctgaactctcgtttgacttcccttcagaacacattgcagacgaatattaacactgttcaaaacaacttgaataatgttaacaacaacctctcttctcgtataaacaatgtagaaagtaatcatcaaagtcagattacaaataactacaactatgctaacggaacctttgtaagagatattcgttatactagccaaggtgtgtattatccaccagggaacgaggtttcttggacttatatctgttcttctggttatgttctttctggtattatcgtacaggaaacaggacgtagctctgcggataacatcggtggggtttacttcaaacgcctccagcgcaacgttaacggaaactggtacgatattggaggctaaatgatatttacaaactttaaaaaatatattcctgaagaccctgaactaaaagaattggtagaagcagagaacattctttttcttcgttgcgatcaaggttacgactggtatgatttacgtagcacagaattcaataacgataaaatgaaagtcgtttttgatgatcaaaatcgtattgtgttttggaatactgatcctacactactttgccctgaagatctttctatagcacaagtagactttaacatagatacttttgaggatattaggaacaaggttctggatttagaaaccttaactcttaagaataaagagtattcccgtgaagagttgatgacacaagctagtgcaaaaattcgctctttacaagaaacagcggtagcacttataacacctttacagtatgctaaagatttagaaatggctactgaagacgaattagcttatcttaaaaatcttcaagtttatgtagttaaactaaatcgtgttccgcttcaaaaagactatccttacgctatagattggcctacattaccgacagaataagggatcactatggaatttcaagaagcatggggacttgcaaaggatgcaataatccctttaatcggagtcatctggttctttttcaaacaaaaaatggataaattcggctctgatcttgaggaaatggaggagaaaagtcgagagctagagaagaagttggtctttgttgaatcaacttatgcaactaaagccgaacttacccagatgctaaatcaaattaactctacattaatggcaaataataacacccttgagcaaaaaattgaaaagattatggacctcaagaatgcgactatccaaatgatgctagatgacatagttaaacgtacacagaataaggggtaattaatggcaacattcccaacatatccagcaacgtctctcgaacagggcgtagacctggttattttctcatctaaccaactccatgatgttattaatggaagtgctacagagagtattgaaacagaatcagggttgataccaaccctgagaaaagcccttgttgacaactttttctttaaaagcccattggattgggcgcaaggcacaaacgaaacagtttttaaccaacttcgttatttccagaatggagtgttgagtggttattactatgcgcctaatgctacactggtaaacccaattcctatgcaagggactccagtaggagataacaactgggtattgtggggactgaagacagaacaactagcaacagaagtcaccccttgggtatattctggtgcaactggttatgaaacagtaatcagtcctccctacatctttgatagtgctattgttacaatcaatggtgttattcaggttctgggagaagctttccgcatagaagatagtaaaatcattttatctgaacctttgggacatgatcctgcaacaggactgccaaacaagctttttgcctatattggtaaaatcgtagcttccgcagatacagatcctaacttagaaaaccgtcttgtcagtttagaaacaaaaactgaagaactgacagaaagcatggataaagtacctttacaaactattgctcgtaaatacggtttgttggatgatgaagtagcttacgcaacagcgggtcaatcattaacagggattaaagctctgtatgatccagtagcacaatcttcctacacattgcctcctaacatcacagggactttaacatctttgtctgtttctggagtaatgacttattctggcggatctgtagatctttctgcattagctgttgaacgtggacagtttgttcatttgcctacaagctttggtaataatgtaactctgacagctaaaaatcagacgattggacgtggtgctggtcgttatcgttgggctggaagtttaccaaaaagtattttggcctctgacacgttagagacaagcggtggattaggtccaaacgcatgggttctaactaatacggaaggactgttaacccctcgtggtggaacatacaacgatttattcgatgttgtctacttgtcagaatatgctaacaatacaactacctataccacaccagaagcagctttccaggcggcactgttagcagcaaaagcttcgaaaagtaagattctcgatgcttacggttgcgatatgactttcacgacaagctcttttgatattcaaggtatcactttgcgtggtggtgtgttccgtggtcaacgcgactatcgtgtgcagaatgctacagtagaaggcacaactttccgtaactctcgtgttatgtattggggtggtgctgtgcgcatgttcgattgtttgtgggacggtgctcctcgcgcaggtcaagttggtagcttggtattccaaggcaacccaatatcaggtacttttgaaattgataattgtacttttaaaaacgggttatatggcatccttcaacaagggacaggagaaccagtaacacgcggtgtcttccgtaaccttaccttcatggacatgcaaggtgatgcgatagaactgaacgtcatcaataaacattatgatgatggttgtgtgattgagaatatttacctgtctaatatcgatgggactaacgctcctattcctctgtccaactggggtatcggtatcggtgtagctggtaaaggaccatatggttacggaatccctgatgatcaatattgcaagaatattacaattcgtaacgtttttgcaaaacgttgccgtcagattgtccacgtagaagttggtcgtaatatttctatcgaaaacattcatggcgatccagatcaaaccgtatctgttgggacaggtttggcaactggcgcagttgtaatgtatggaagtaaagattttacgattgacggtgtttatggagagcctaaaacagacggtagcacacttgcaagtaatatccgtatgatttatttggagtggggaactaacgcagttctggatgaagagggtaatccggtagttccggcacagggtagaccttcaaacccatgttttaactattctgttcgtaacattcacaccaaaactgggcgtgtttttgcgggagtttccgctgggccaggttatgaaaacagagttagctttgaaaatattcgttgcgctgcattgcagttgttcggtatagcttcttggctttcaatgtctaacatcacctgtaatatcttcgattgtgttggtcaacctgaatctggtccaggaacattttatgatggattcttccgtagagaaaaatctgttcttgaaatggttaacgtaaactgttacccagatggcaagacgatggttactggtcgtccacagtggagccgttgccgttactcggatattcatcgtgtcaactgtaatgttgaagctaatatgtataccaatatcgcaggtggtattggagctattgtagggacaacgggcaaagtttattacttagagcctaatcctagtcgaaacattgatggaatgcatttcccaacagggaaagagtttgacaaaggtgatatgatagtcaaggcggataatacgttcttccttgtaacaacaagtggggcatatattccagatatcccagctttcggtattcgagctacacaagcaggagataccttcctgacacagaacttgactcctaatgggacagcaacaaatgcttcttggttgtatcattaccctctgtcagcagggacacgtatccgtattcctggtgctggcgtaggtggagcagatttggacacagttattactcgtgcaccttatcaagataatgatacgtggactaacccagttaaaatagacattgcagatccaattgtaacgcctacaagtgctggagttagaattaaaaccatacctaatgattccagtaatgtttctgtaggtaatactgcagttattcgcccaacgccagtagtagatgtgccaacaacctaatggaatagagggggattccccctcttcttccaatagaatggtctaatgataggagagataaatgaatttaacaagacctaatagtgcgatagccgatcttgtagaagctacttatcgaaaacgtcgcagctttgaggcaggttttacattacgtaattcccgtgaagttttgctgttagcagcagaagggaattattaccaatggaaaggaacttttcctaaagtagttccagcaaactctacgccagccaccacaggtggtatttcttcccttgcatggcaaagtgttgggaccgctgatgatatagcaattatcaatgccaagtttacggcagtgcagcaacagatcgatgatctgtcggaaacaatacctgaagctggtaaatcagcttatcagatcgcacttgataatggttttgttggaacagaagcacaatggcttgcttctttgaaaggagatactggtgctcaacttaatattaaaggatcattagcaagcactagtgagctaccatctacaggtaacgttgcaggggacggttatatcgtaggcgatgtaatctatgcttgggatggttctgtttggaaacttatttcttctcttggaccagaagggaaatcagcttatgaggtatggttggcagatggtaatacaggatctgtttatgattttcttacctctataaaaggtgataaaggtgatgttggtcctacagggccacagggagcacctggtgttaacgccaacggttttgattatcgtggggatttgccttctacaagtaacttaccacaacctaactctgaaaacgtaagccaagcttattctatcaatggtaatctttatgtctctaatgggacagcttgggtcaacatgggtaatattgttggtcctcaaggtccacaaggtgaggcaggtaaagacggtctagatggaacagacggagatgaagggaaatctgcatatcaaagttggctggatgctggtaatgaagggacagaagtagattttgttgcctcacttaaaggtccaaaaggagacaagggtgatcaaggagagcgaggtccacaaggtgaactaggtccacaaggaccagtgggtgcaacaggatcaggcttagagattatcggggttctgaacagtgaagctgaacttcctcctactggagaagtaggtgatgcatataaaattaataatgatttgtatgtttggattcaagatgctacggaatggatgaatgttggcagtcttggaggaacatcaattacagctaaaggtcatgttccgaacagtgaagctctccctgtttataataactatggtgatgcctatttaactgaagacactagtaatctttacatctatacctacgatcaagacaccaattccgcatcttttgttgacatgggaagtattaagggcgacaaaggtgaaaaaggggataaaggagataagggtgatcctggaacaaacggaaccaacggtactgatgggaccaacggtaaggacggcgcacagtggtttgtagcaacaactaatccagtcgcaggagacggtgttatcaatgattacgccttcaatactaccactggagcagtgttcaagaaaacagattcttctacttggacacttataggaactcttcctagtataccagaagcccctcaagacggcttgacgtatggtcgttctgatgggaactggattgaaatatcaggatcagatcctacggaagctataacaccaactagagttacagcaggtttcatggaacttgaaacaactactgccaactctggagcatcttggactccttctggaacttccaatatgtatgttgttacagtaaccgatgctttaacagttggagcatggcctggtgtcactggctctacaaagcctaaagcgttttcagcaatgatttatttgattcaagatacaacgggacacacggttacactagatgcgtcttatggagcactgaatgatacagaaatagcaactactgctaacgcagtaacaattttgcaattaacgtatcctggtgtgggtaatatcgttgacatggttgttgtaacacgataacagaagccccgaaaggggctttctttttatggagggtttaaatgtttccaattccaatatttactattatgactagcactggtgtcgttcctctgccagcaggtattgttaaaaaagtaatcactttagattacccagataacgctggtaattctaacagtagtttagcaattttgcttaatgatggtagattgtttactcaaggcgcaaacctctttggtgagattgcagatggaactcgtagtgcacgattcaataatttccacttagcttctactgtagtagcggatgtgtttaccgcagatcgttgttttgttattaaaactaacagtgggggatggcaatattcaggattgacagcagggttggtaggatctatagcagcaggtggtacggatgcatgtgtaactacctggactagctttccatctgtaataacagggactatttctttagccaatcttaaagaggttaaaggagggtataacaatactctctggttaatgaatagtggtgttctttatggatcgggtcaaaacacagtaggtagtttaggtgcaagcactactaacgaagtttctactcctcgtcagataacaagttcagcagttgcttttgatgcaggttacaaccaatgctcttatgtcaacaatgtgggaaccttgcgtgtttgtggagctagtaaaggtttagcaggtaataataacacaacaaccgcttttgtcaatgccacgatatccactactgaaacagtgtatgtcaaagattacatcaatacagtttcccagacaatagttgtaggagacacctccggtggtacgggcacggtaaactacttatatgtcaggtctaatacagaaacaacctacactaaactggatacctttgcagcaggtttctcaacatggaaatttccaccaagccgccactcttttttcgttgggatcaacaattccttgtgggctattggtaagaactacactgcaaacttaggtttggggtatgattctgcgagcggagatccactccaagtgggaaaaccagttaaacctgaaggagtgggttcctgggatataaacaagctcacaagcgttcatacgctgaatatggatgttactaaccaattaggttatcaaggaacctttttcgtttataatggagatatgtattattccggtatttggaaaaatgggaaagcctcgtatctgttcaacagtggtctaaattataataaattcacaccaatagcaagctccgtgattacaggggatgtgctggcaactggcttaactacagattctttaggaatttgtattgtaggtggaactaaacagttgacacattctgttagcccagaaggaggtaaacttttcaatattaaatacacttcttctgcccctgcaaacatgacaatatcgtctactggtttaatgactttccatgcagaaggtggttttgatgcgggtatgacagccttaaacgctgaaggaacaactttatcagatacctctggaggatatgcttcaacattaagtgtttacactcctagcttatctgcgatggatgtaggaacaacacaaataatggtagcagaaataacgccaacaggggcagcaagcttacctggtatggttgttgagtatacaactacagatcctaatgttgctacagtagatcctacaactggtgtaataactggtgttggtgatggtggttgtagaattggttgcacagctacgtatcaaggtgttgttaccgcttctgatagttcttatttaacggtgaacgctgttgcgggaaaggagttagctccatctccgagtagtagcttaacggttctaaacggatatttcaaccactcggcagatggggcgattacgttcccaactttatcgggtactgttacaccagctaactttgtagttaaggtggatgacgttgtagttccttcaagtaaagtaatatttagaaacaaagctttctctacagtggatagttatccagcaggagaatatagactggctattgaatttgcaagtgcttcggtagttaatagtgtggaagtgtctatggaagcaaacccaagtcttttagaattatggggcggcaacaggattagttattctacaagcccagcctcacaattcttaaaaggttgtgctaacttaagacgaataacctctgattgtttcagtaacacatcttacaccggaacgtctataagtggtattttctctggctgcacaagtttgacagctatccctgaaggattattcagcgatactttatttccttcgatgacaacaatgtcaagcacgtttgaaggttgtacgtctttaacatctattccttctgatttatttaaaaatttatcaaaagttacaagatattcttacacctttaaagattgcacctctcttgcagaagttccagcaggaatgtttgataatattccaacgaaagtgacctctttaacagctacattccaaggttgtttaggacttacagattttaataagatctttaatgacaacccagggttaactgtttgtggtaaacgtggagcattatcttctttctttagtggatgcacaaatcttacaggaacaggaacaacattaacaaatacattaggcggagtagctaatagttacctattcaggtattgcacaaaactttctgattataacaacattccttccggttataaataagaaaaggagccatttggctcctttcttttataaaaactctttataaatcaataagatcagaacggaatatcatcatcgaagtccatcggaggttcttcttgattacttggagttggttctggttgtggttcaggctttttaacttctttcttctcttctttcttaggttgttctgcggaaccacgaatggcagcagcaactttatcagacagagccagaactttacgagcagaatcaatcagatcttctacagatacagtcttaatggtatggtctttacaagcattgaggatagcgtgaccaacagatgccccaagatcataatcattaatatcaacgccacgagattcagcaatttcagatttcagcgtgacagttgcagattgaacaaccccagcgatatcgaaagcatcgcctttaacaccattacgaatcagttccagtgcaccatttactgcgtgaccagtttccagacctacagtatcacgttttttataggactgtttaggagcagcatcgttggaacctttattgccagaagatttgttagacttctgaacaccatcggtagacaatactgtaatacgagattttttagtattgtagtaagttttaccgcctttattatcaacgcgatcaatatcaatacttacttctacacctttttcaatagtgatccaattatcaccttctttgacttgcaggttttcataaccttctttcagttcaatgtcaccaagagaaatccaaacacctttctcatctggtttagcacctttctctttcagaacaagagaggctcggtgagttgaaacaatcgtttttccttcccaatgaaaagttttaggttcagcgaatttatccagtttaacgtagtctacgataccagttgcataagttacggttttgcctttacgatcagtttcagtattaattacggacattattatctcctctacattacattaattttgcacagaaagagcggagtctttccatatcatcttgctctaacaggtatttacctttacctattccaactccaatttcaccattaggaaaatgaactatttgcactgggaaacctccgagtttaattgtggcagctttgccttcttcgtctataacgtttcggattgtatcttgcagtgaaatgaattctttgtttgtaacagtggtttcaattatttcagatgtttcgacacgagcagttagcttcttgtttccaccttgaataaccaaaatttgaaaataaaaagagttgtcaagacctacaacatttttctcaactagtgttaaactggtataatttccataaacagtttcaacagctatcttagaacgttcagtcattgaatgctatcctatcataaaatgtttaatattgtcaagctttaattaccaaggaatatcatcttcttccaatctggtatctacttgaggtggacgtggaaccttaacctctttcacaaaacgaagatatgggaaacgtgtagcaattttaataacatgtttggcatcttctctaacatctttgtgcaagaagcagatccctgtttccaaggttgtttcaaaatctttagaataataacagtccttcccatcaaatgcagcctggcagatggacagatcgaactcatttagaaaggttgtcattacgcttggttccataatcataaggttgcaaagctgaccatcacgttcaaactcaaaaacgtgtttaagaccagtaacaccttcataattatcagaagcctctttgtttcctagtttacgaatattggttcccattaaagcagatgcaattaatccttgtatttgttcttcagtccgatgtgcaggaagagatgtatagaaatccagatcacgtccagcaatatcaagaatacgccaatcacgaacagcaccgccagccaagacagaattaggatcagcgatctttaatacggtaagaatttctttggcaatattgatttgttttgatttagtcattgatacgctccacagttacttttacaacatcgtccatattaatctcatcccccaagacctcaataacaccttcctcataaagtcgagcacattcttcccacacttcagcttccttcattccacctgcaatcttatttgcaagacctttaataacatcttcattttgttcatcaacaagaattgaaacattaaagctcactaatttacgcattgttttctccttatacttctaaacggaaagtttctttagatacaaaatcgtatccacctttttcaagccagtcattgtaaacctcatcggcttgagactctatcataaaataccgagtggtaacttcgtctccgacaatacgcacaattttatagcaaatcatgataccatttcccattaatcttcctccagatcaatttcattataacaatgtatgcagaaaccatcattgtgcatatgttgttcataggacatatctttaccacaagaccaacaacggatatccccatcgtcccattcacgttcttcttcaccttcaaattcatctggtaggtaaggcataccaaaataatctaaatcgtaactcatatcttctcctataaaggggcagaagccccttataaaacaacatgttagatcaatgacaggatgcccaggaattacccacgtcatatccggcagtaagctgaacgttaagattgtaaaattctccagccttagtaacagctaaagcagcaagctcacctgcccgactataagctgtaaaccatccacctttgggagattcatggatgttagcccaaatttgccctgtctctttttccttattatgcttccattcttcaactttagcaaggcattctttatcaattttcttttgttcttcaggatcgtctactttcttccaacctaatgattcaggtgaaaaccatttgaattctacaaggttacgagaaacttcaagctgggcttcatcgtggtatgcaatcatttgttgcacggagtctttattcttccagtcatctttaaagaagtcaacacttagtccttcttcttcgatcatatcgtcataaataaccattgcacgtttagcacagataaccccaccactttggaacagagagttaagaatcgcgtgagcagaacgagtaggaaccttacgaccgtcaatacccaaaacatattgtttaccagtcttaacccaaaaatcgtttaaacgttctttaagacgcgccaatgggaatgcagcttcccagaaagcatcaaacaccaattgacctgtaaacttatcgctaccaattgttttagcaaccttgtcggcttgtgcaccataggtaataccatacttaacagatttagcaggactacgttcaaatttacgtccaatagtttcagtgatacgttttgccatcattgtgtgaacatcgttaggtttctctaacaacagagcgttacaatattcatgaggctccggttcgtagcgccaacagtttcctgtgatggtaatgcagtctttctgacgcatgacccacgtaccaagttctgtttgtggacaccaaacatcctctacaccccactcttcaatagtcaaactttgaacaggaatgtgagagcggttagccaatgttaccacttttactttctgctcttttgtattgaaagctacagagatattgcctccatgcaccaggtacgaggcagttaaagctgcttcaaaaagttcacctgggttctgcgcccaacgccaaacaggtttttgtttatgttcatgccagtaaccatctgcaatcaagaaaccttccaagaaagctacacgctcggcatgagacatattaactacacgctctacccacggaacatcccatttaccttgttgaacagaagttaaactatttacctgatcttgttccatgttaaatggagcattacaaataatattatctcctgtgcaaagctcggcagttgttctgactttaggcacataagtattccctttactacgggtattaacataccaacggtgatctgctgttgcacggtaagtgtgtgatttccctttaatctcaaacgtcttactatttttatagaagaccttaccttttactttagtccattctttcagacctgtttcagcattgtaccctaaaatctcatccccttccttcaggtcgtgatatcctacccaacctttacgagtcaaagcttgagcatccatcggcacacagtaatgcgactcaatctttgcttccaaagagtcgaagtcataaccgatctggaagtatttaggaacttctacaccaaacaagttacgcatctcccatccaaacaaagatgtgacacgagggatattggctacagatctatgcttcatacgagaggttgcagcatcacatgtagcggctggtgtaggaatacgcccatccgcccttactgcggctaagaaacctttatcgtattcttgatcttcttcatcttcttcccaatcagcaccgccacctaaaatagagttcctacgatgcttatacgttaagtattctacaatctgagtagcataaggaaatttctcacccaaagcttgcaggttaggacagatttctttttcctgacctttggtaaaacatgggttagtcaatactttaagaccgcgacctttaccttttgctatacgctcttgaatcttcctttccaaggtttccggtgtgcactccagatgatcacaacgatcctgacaaaaattagaagatagagtttgctcaacgtaagctcgaatacctttctgaagttcttcctcgctctttttaatcttggtgccagatttaagagttaagtctttatctttatattcagacggtacccaacctaatcctacaagccagtttttaatatgggttgtatcgtttaatgttgcagggatgtgaggatcacataaaggctcatctgctgcaactggcagtttccactctttccccaacataactaaccaccaatctccatccctctcttccaaatgaccatcatgtttcttagcaaaattgatcatatggttagttggctctaagttctttttaatttgcaacttaggtggaataaaagccttaagatagccttttgttgctggtttaggtggcaaaataggctcaacgagtaaacgaagacgctccatttctgcatccaaaaaagcaaggttctcttctgcttgcttcatgttaaaagcaaacccacggtgttcctggcgtgtgataatgtctgctacacgttgttcaagttcaaatggaccttcccatttatcataatcaccccattcttccataaggtagttatatacgctcgtattggctttgttgtcatagatacagtaataaagcatatccgcagcaaaagtcttaaatcgatcttcttctggaatctctttacggaaatctatttttacatcaccacctgcttttcgagaaagtgctgccaagctatgtcctgatttgccctcaatctttcgatctgggtttaacactttactcaaaatcaaggagtcaataagttttaccttatttttgccccacgtattatatttaacactgtaatctaatccataaaacagttttgtagccaaccagtcgtagttgataccgttgtgagccacagccatttcaaccagatattcaggcttctctttaaaataaccttcatgattaataaagtctgggaaatcttttagttgaaaatgcgtgtaatcttgcgccacatactctttaagaacatatgtgtatttaccatctgactcttcataaggacgcccatcaaagatgtatttagggccatcgtggaaagctactatttctcctgtttcatggttctctaagacaatacagtgcatttgaaatgtgtctttgagacgataaggactagctaaataatcaatagtgtcattattcaacaatccgtttgcttcaatatcccatgtaaacttactcactattcctcctttctaatgttctccagaacccactgaagttcttttaaacttaaacttcttactcccgcagttttactagcttcagctttaagtaacgggtaagcctcaatgatacgcgttttaagatcagaagtcaaggcttttaaaaaataggtagatgcttcagataaagaatcttcttctgataacactttacctgcacttgctcccgctctcctaacggctatatcgtagtctttactgttacctaatacgaatagttgattctctcctaaaacaacgggagaacgcttctcgttgcgtttaatccatatctggaatacacaaggaacatcccaaggttctccatgaagaataaaagatccttttggacattcttcttcgtaaagaagatgcatgtggggatttagtttgtgtgcaaaaaagattttttgaaatgtgcgaggcaagataaaacaaataccaccttcgttatccaacatttcagcacaatggttaaagaacttaatggcaagactagcattttttccaaatggaggattaccgacaaaagcagttacactaccaacagactcaacagattgagctaaaaaatctgcctcaatacaatcttcaaacttagggtcaatatcaaaagaagttatgtttttaaaacaagaagagaaagctccttctcccgcagatggttctacgtagttagcttcctctccaaaaatttctttgatcttatcacataagaaccccgcataagcggggttagtgtaatattgatcaagtgtgttcaacttgctcaatagtcctccttagttgttagcgaactcaatagtgaggtcaactttaccatcatcagaaataaccatgtttttggtatttttaaagatgatatctactttaccttcgcttacacgacagaatgcaacaccatctgcaactttatcaatataatatttgtaagaaagaatacccactttactacgaccagcaccttttgtgaaagaagggcttacatcgaaacggaaacctttagaagaaacaacacggtaagaacgtccagttggaagatgttcaataacagagacattgttctcaacaacttttacagcaaactcttcaggatgatcctcaacaatcatatgtgggatggcaaatgccaacgcttgtttgtgtttaataacaccagcacccagagcaccagcagctttaacttttgcattcagatcgattgtcatacgcatttttacttctcctcttgtttggttgatgagacaagtataagtcccttccgcaaagttgtcaacaggtatttttaataaaagggccgaagcccttagtagttgctatccgtaggtaagttagcagggttgttaaaatactgctctttgtcgtgaagagttgcagttctaatgtcatagtaaaactgccctgctggaccagtcttggataaagcaatgagttgtattacgttctacaggatcttcagcagccttatctcgttccaaagccaaggtaataccagcacctttagccaagaaactactacccattgcatcgtcctctgttaagtgctcattgccaccattagctgacttcttaacgtgtgagatgacgataatagttatagcatactctttcatgattcgcttcaaccatgttgctaactcttcctgggcttgaacatccataccagaaagcaaatcagaataagggtcgataacaagaattgttactccaaaatagatgatcatctccaaaactttttctttgatagactccacatctgctccacgatcatcacacacgtaaaaacgtggtgatccatcttctctttcgtaaaaatctaggattttttctttattctcttccaagatttgaaatttctcttccggtgttttcctgtgtagaggaatgtgtaggaaagaggataacaggttacgagaatactttttataagtcgcttccaaggacagaatacctagggtatgttctgggtgtgcaacaataatatgtttggtgatctcgttcaccatcaaagttttaccgatactggtctttgccaggatgactgtaatctcttcctctactaaaccaccacccaacatgtttgcagcaacacgcataaaaggaggcaaggtaatcatcttggattccaagcattccaatgcagcttcatacaagacattagaagcataaacacctgctggggtgtatagacgagcactccaaaaagcttttacgaaatcttttgcacggccttcttccagatactgattggcatccttaagatccatctgcatacggtagactttgttacgaggtagcaccttaacaatattttcaaatgcctcattacctgctttgtcgttatccatgcaaacaataatcttcttaaatttttcaaagaaaggatattgtgcctgaacttgtttatacatactggtttcaccagttgtgccacttactacggctggaagctcatatttactgtccaagttttcagatagcatttgataagctgccagagcatcgtgttcaccacctgtaattacaacagtatgagaacggtctgcaaaacgaatttgtccaaaaagatctacatctttacctacttgaccaataggtttactgaaatctttaggatgaatacgacgcttaaaaccaaccaattctttaccgatggtagtcggatataaacaactttctactaccatctgatctccttcctgacggtattcataacgaacaccatagaaagatgaaactttttctttaatgcctcgataaccacgtgggttggttgatgtttcttgaacaattttacgatgaatctgtttattaaattccgaacccacaatctcctcctcttcttctaaaacttcaccattttctcgtaaccattctacgctaggaatagtgtattcacacgcaaagcacttagcacctttatgctctccattagaatctaatccataaaccatcaggttattacgagagcgatccttgccatttttcatgcagcgcggacaacctgtatgcccttccttgctaagatcaacatcaaatccatatttagttataatgtgcgacactttgttctcctgttaaaatggttcgttagtctccatcatatattctgcttctagttcttccatgtgctttctaaattggaaagcaatttctgctacagttacatttaaatctttttcaaaaacttctgtagatccttcataaaaacgaataccgtcaattaaaagccctccgtggtaatcccaatcactttcacgagaaagcggattaggttcttcataatagtaatccacctccacaaccaaggctttcccgttacgagtggtgtattcaaaatcaaaagtgttaatcattatagctcctcaaataaaagtctacgacgctcattcaacacatcaatgtgataatgagtcctgacatacttagctaatgctaatcctttctccatgcaaacatcgggagcacttaataagtattccgtaatatctttccactcggaaggtgtttcagcaaagaataacaaatctttaaactcttgtgtatgataattctcacgaggagagcagattaaaggtaaacccttagcacctgcctcaagaattttaagattgctttttgcattattaaacacgttatcgatcaatggtgcaagactgatttgatgaccatcgtaagattccatgtagttggcatatggtcttacaccttcataaacacaagttggtgctacattttccctgattaaagaccattcacgactacttaaaacttcagaatccctacgaaaaccacatattgtaagatctttaccaaaatcgggcaagatagccaaatcttgtttatgtgtttcacttccagcccagactaatggagttttggagtagcgatcacgggtcaacacaaattgaccttcatcgtaaggaagtccattagggattatgtgcacattatcattgtattgtgaaagttcaacttgcaaggcaggtgtcgtagttgtaacaagatcactgtgctctaaaaaccattttaaatgttcacgaatacctgattcaaaaataccttctaacatgtgtccttttggaataactaaagagtcatccaaatccataaccattttaaagcccaggtttttaagggctaaaaagccctctttaccttttgttggcactccgttaaaaacgaaaacgttgtgtttaggttgtgaagagaactgccttgagtaaggcagcactaccctatggaaatcgcagacactataattgattccgttacgattgtcaagaattatttgtcccatacttcacctacaaactttcaataacctggcgtcgcaattcgtttgcatctgccagattataatgtgttcgaacatgttccgctaagaacaagccgcgatcttcccgatagttcggattgcgaagaagcttaacaatttcgtaatgccattctgctttattctctgcgtaagcaacagcgcgagcatctacagggttaaaataaggtaataccttagaacaaacaatcggaataccttttgccccagcttcaaggattttgagattacttttacaattattaaaatcattatctaccaaaggagctatagcaatagcatgactttcgtaaacactcatgtaattatctaaatcttttacagcagctttatatttggcgtttggtaaatttctacggatcttaatccactcttgccctgtgatactctgcgatgcttcatatcctgcaatagtaagaagttcatcatcgaaagtattagagactagtcgtaaatcgggttcgtgactagcaccgccagcccatacaacaggggtaccggatgaacgatcatttgacaaagtgaattgtccgctatcaaaaggaagtgcatttcggatcacaacaacattcctatttaagtgacggatcttatatgccaaatattccgtagtcacaatgaccacatcggcaagcttaaccatagctacaatagcatgagtgtttgactcatataaacttgctaaataatgttctggattaagttggtagaaatcatctaaatctacaacaatcttaacaccttgacgtttcagggacagaacatattctgcccctttagaatgaatacggttaaacacgacaacatctttcttaggctgaaaattattgttgttaaatggtataacaatacgatgataatcacaaccactgtgaggttttgcatcaattttcagtttagtccattttttatttgacatgtgccagtgcctcctcataagaaattcggattttcccatttttaatatcttctaaagacgctttatattcttcccagttaatgccaatagcaacttctttctcttcttttgtcagattagcaaaaggcataggattgtttccaaaaacatcgtctgggtggatataagccatgatacgaagtggacaaggtattgcctgaataccctgattcaaaccagcagctttcaaacggtgtacccattcagcatcttcaaaaccatagccgtgagtgtaagggcggaaataacccatcttctcaacaacggcacgagaatacattgcaaattgacacattgcaagttcccagagaataacttctcctttactcccaacaactttatctttgaaatactccggcataccaaagaaatcccatcctccagagacagcttgatctacaaaatatgtttcccatccctccatgattgggtagcaatcgtcgtcaaaaataaaccaataatcataaccttcttcataaaactggtgcataagttcattcctggcgtaagctacacctttacgatctggatcgttgaatactcgaaaatctgcatgtggatctgttacaaggtagtctttaagtggacggacacctacagtgataacacccactccgattttaatattttccattttctctcctaaatagttttactgtgatcgtgacagtgtaataaatgatgtatagaccgttgaggatctgtttgacctaatctgtaaatgtgaaacagatacattccccgcatcaatcctaacctctttcctttttcatgtaaagtgcgagagaaaattaagtcgaattggatagatttttcttcgaaaggaatttcattccacaatgattttctaaaaagcaaaaagaaacctgccagaggtgttccgaaaggaacttcttcaacactcactttatgatattctcttgcaatcttagcatattctatatggtttagaatatctggatcatcgttaatttggttagagaaaagctgataaccactacctaacctgttacaagttgcacctattacatcaaaaggtgggtttgacataacaaactcttcaagcatagatggttgatcaggcaggaggaacatcgtatcggtatctcttaaacacacccaactatcatctggaagaacggcaatagcttcattgatagccttgccgatatttcctgtcagatagggagtaatataataaatcattctcccctccgttatattaactgtcggctacaatcccgcgtttaatcatttcctgttggatttggatgacacgatctcgtgcttccatgtattctttaaaagattcttgaagatggtcacgagctacgtctcgtagcttaatcagtttgtcgtttgtcacttcttgaagagagatttcgccagtttcattggtcccaagcgttttcatttacaacctccttaatagctactgcacagttcttacaaatacattgacctttgttcttagaaatttcaatgtaaggttcattttcgttttctccgcgtcgtgagtcgtatattactgtattgaagcagacaacgcaaatgtttttaataacgacatatttttgcactttctgtttagtgcgaaaattgacttcaatgacttctcccatcaatgaatctcccctaaaatgttgttttgagacattactgcggagcattctacagcatcatgagtccttgcaaaacgctcccacaacacagcatctactttaagaaccatacaaggataaatactgtcgttgatcatgtcaatgctatatttatctacatccttttcatcttccataaacaaagtagcgtatgcttctaaatgcttacgggtgtagtatacatcctcttcagtaagaccgacaaccaggtaacttgctacaacaacagtattatcttcttgcattttaactcccctttggtagatagaaaccatgcactttatctcgataaacaagacgcatatcacgttcccagtgtgtccttatattccgtttcttgaaatatagagcacctttagtaacatctaaaacagaccgcaattcaggaaaatgtttctctaaataaagtaaacgctccgctattgcttttgcttcctgccacttatctttctctgttacgttaaaagttttcgcatatgagaattgccctttctggaacaagactcctctgactgtgttagggaagtaggtatcatttcttctgttgattaccacattcccaacggcattcattccttttttacccagaccgcgaccttctgcgtaaattgcacaagctaatagaattttatcattatattgctttgtacatttgtgaactactttagcggtttttacgtttgcagcttcggctttcgccacaacaggtgtaaatgtaaaagcagttaaggatagtaacgcaactgttacaaagttttttatcagcaaattttgcctcctttttaagttaacgaatttctagtataacacgatagaggctttattgcaagagggggatttctccccctcaaaatcatttgttagttattatggacattcataccattcttttttaccaccgaaggccatcaccacatcacaaatatccagaccagctttacctacaccatatgctttcagcttccattccccatcttcacgaaccaaggaagccacgtggcagattgtgttgccagctacttcaggagccaggaagtcaaaatccagaatttccacattgcgctcggagtcgaagattttaagcataccttcagaagcatgaccaaaacgtttcagacctgtatcatcatcaatggtcagaacaaaggcaatctcttgtgcatcaggagagattttagccagagtaatatcaatctgctccatgctgccagttccatcacgaacatcgtcaccagcgaaggtagaacgttcaggatcaaacttgttagcatagcaaactagatgacgtgcagacagcatttcaggattgccagcggcattatgacgacaaaccagtgcacttacatccagatccagtttagaatcagatttccaagagaattctaggcgcagttctttcagagccggagcaactttcttcagggaaattttttcgctagagccttttttcagggaaattttatcagtcatcttttgtctcctctattatttaagtgtaataccagttacagtcaattctacttccaaaagcttagatgtgttttggattgatactaattgtgcatgatggtttagttctacagcagaataatcattttccccatcatctacttttaaataaacaatgatttcactaaggtctaaaccattttcgtcaaatgcattttcatagacgaaagtatctcctacatccaaatctttaatggtaaggcatcgtttatttactttttgctcatcaatttcgaagtttaacacttcttcctcctaatgttatctccggtttgtatatacgaagaattatagcattttcattttctttgtcaacccattcttcataatcaggccatacatgaatctctactctacttacaatatcttccattcgcacagtcccaatgaaatactctttgagactgcgcataatgaaagcttctctctcgcgccaataattttctatgacttgagaggcaagctcgtcgatcattttttagcacctactttaacaacccactctccgaactcttcagataagagtttgtcataaagctctgaatctgtcaagtctaaatctttaataccaataaaaccaacattatcataagcatttgccagttctttcaggaagccaaacttctcattaccaacgccaaccatgaaccaataaataggtttattcttattctcttcgataagacgacgaacagcactaggatcaccattctcaccatccgtttggaagaatacaacaccaggggtaacgtcagcacctggttcagatacagctacaaccttttcacgctctacagatactgtttcagttttaccaagtagacgattaaagaaacctttctttggagcctcctcttgtaccacttgtttagtggtaatatatttggtaacagtgccaaaatactcatcgtagatatctgccattacaggggcgtaatttgttccacctccgatacgaacattacgcatacatttaccaacatagtcatcgtaaacgtctgctgttgctggagtaagctcttgggaactcgtattgaaggcccacatatcaatttgttgattatcgtcgaacagcataccaaaaggaagcagtttacctacaaaatcactcactaccccactagaatatagaccatgcatactaccagaaatatctagagcacatgctacacgaagaacaatcttaccttcattcaggttcttattctttttcagagagaaagcaaggttttcttgacgttttttcaggctgattttctcggacatattatttctccttcttaagtgtaatattggtaacttctaaatctacttccaccatatttgtatctggtgggatgcaatgagtatagcctcgttgtgctagtgatccattaatacaaatcgcactgtttgtggaatttttaatgaacaccaagttacggtaggtatccaaccctgcgtcttcataggcatcataatacatgaatgttgcccctacgtcaagatcttcgaaagcaataggtaaatcttgacttttttcttcttgaatattgaatctaaacacgcatacctcctctaccaattttgaagcccaaatcgtaagcttccttagtgatcttttgtaactcacttgtaggaagtgttacaagaggatcatcttcttcaatttccatcttgtcatcttctgtttcaatgagagtattatgcactttgtgataagggttgtcaacacgtttaaacttattcttttctgtgctgaaaaaacaatctggatcttcttcaccatcaccccaaccttggttaggatctccgtcagattgttctgtagggatttcacctgtaaagtactcttccagcaccatagcgataccgtcccttggatttgaggaatgcatcaaatcacaaaccttactccaatccatagcccattcaaatcgttcacgaacaccattttcatcctcctttccagagaaaacacaaccataactatcatagttgccatacatctcttcaataacaacaccgtccttcaaaagaaagaggtagcaaggtgatccgtcgaaagaagtagaaagggcagctttgcccgattctttgcacaaaaagctaaaacaacccattacaaaccctccttcagattatcaagagctacagtggtttcacaaaattctccataagctttatgatgttccagaaaagcttcgggtccaccccagtcattatcttgtgtattccagccatcaataaaagcatcttcaatgattgtgatcagttcctgtcgagtcaacgtaatggtatcaggtttctgcgtagtttccacacggaaccctggttcttcataaaaacctttagttacaatggattctaactcttctgcatcacagaggaagtagccacaaagataacaccaaccgtcatcatctttcattacttcataaacttcaccacttgctaacttagtgaaaagagtagggtctgttactgtaagttttaaaagaatacctgttggattatacatcttcttcctcctctaaaatatggaacccgtaattacaataatcctgaaaggtttcgtgtgcaagatcttctatatcctcttgagacatatcatcttcaatttcgatatccacaacctcattgcatccacaccaagcagtttcaatattcactcgtaatattttcattactcctcctcctcattgaagtcaatatctgcaaggagttcgaatttacggaagttacgacaaccttcataaatataacaatcacgacaaactgctagaacacttgggggatatatacctcccatcggtgcgaatcgtttttcgtcatcataacggacaccaatgtcttcatcaattatatagatacggattctcatttaccaagccctcgtttcacagcagctaccatcccgtcttccagagattgaacttcattaatataatcaacacgagcagcacgggcttccgtattgatgcggttagtttcttccaacatcttaaccaagttttcctgatcgtgacgcagagtttcaatatccaacacttgacggttagccagtgctgctgcttcgatctgattctgtgtggcaagatcgctacccagtttaattgccaggttaaattcatcaagaacgttattctgcgtctctgctgctttcatttgacgtaagctctcgatatacattgagaagttagcagagtaagcaggaataacattatttactatgttacgcgcagatcgcattaagcttgcagaaactttttgcataccttgtacacgcggtcccatttggacacacagtaggcgcaatgcttttaaatctgcaatacgaatctccagaagatccaaagtatctcggatcacttgtcgctgttctactgcatcttctggaagagcagccaaagcttgttcttctttttcataggttgctgttagaagctgcatatctcggttcaaacttgcagcatattgtccaatagcttgatgtagcttttcaagatataccaaggaatcttcttctttgcgaatatccatttgaaggttctttaccaactcttcaatacggttattaacattatcaaactccccaaacaggtcttctttcatacccataacttttttaatgagtttagtaatacccttgctttgtttaatagagtttggatcaagttgttttgcctgtttaatcaaagctgtgagtcgttcactcatctgatcgccttgattactacgttgatgttttaatacctcggcatttaaggaacgcaaggttgttcctgcctctgccccaatctcttcgatctcttgtcgggtcatagaaggcaaaaccggaacttcttgcggtgcggctggtgcataaacaggactggcatctaacacgcttggagcgaatacagatttacttgcatctgttgttgcagcaaatacgctcatttcaggcttcttctgaccgccagtagctgcttttaaaaatggacttgtcattcttcattctcctcttctgcatctcttatatatggtgaaacaccgtactctttagctactttaacccaatcgtcccatttatacaaccataattttccttcggtcccttctttatctgatttcaaccacatattaggttgcttacctgggtacatgcgattaggtttacgattataacctctaacacatcttgtcgcaaacctatctaccagaacaagaacatatttatattcgtggttcaacggctctttggaagtggctttaggattagcccctaactctgctgccagtttttgccaatgagcaccgtgtctactaaacttacccatacaaccatcaatagcatgagcaatttcgtgcttcattgtatccacgatcatatctcttgtggagttcttatgcaagtgccaatttacaacaacaattttatctcggtagttgcaccaaccgaaagagttattcactttgtttctaacacaagctttatatcctgcttcatgtaacatgttgtagtaaacaggaaaatcttcttttatttcctgcatcacttcccaccacaagagttgcaagtctctctcggtatgcataacttacaccttaaaagcgaaatgcgtggtcgtggcttcaaaatcagggccagataaacttgcactgaaatctgaaatatttgtaattaaaaagcttttatgcatacctaacacagccacgctttcaatatcttctactaacatttcaatcatgttagaaacatggctgaacgtagagttttgttttttgatggtgtagaaagaaagattcccacctgctgtataagatacctcttcaaaatctttaatcgtatattgtgtgccatcagtaaagaaaatggtagctttattagtagcacgtttcttgttttttggtccttttttacgtttactgcgagtaggcaaaccgtttgggaacaccatagctacaaattcttcagcagaaacctccttaccgaaatcataaccataagaaacagcgtctataaactcgtcatcttcatttttaaaataatggaaatagggccaatttgaaagattatcaagcatcttatgctcgtccacagcagagaatgtatccctcaaagcgcgtgtgatttgcaaagcattaggcaaccttttaacacctacgatggaagtacgaatagaaattgtcattgtttttctccttattaacgtcgcttgctacgagatgaactctttttacttaaagggctattgtaagatttacgagttgtatagctactatttgttttaaaagtttgtctcggcttttcataagtttttatctcttgtttaggcttaccataaaaattagttttcggtttaggtgtattataatgcttattaataatcgttctgttatcgttataatccccactgctacgattactaccgccactcatcatatgccctaacaacatacctgtagcaaactcaccaacaccgctactactagaaccgccaccattgttgataatagttgtatctccgtcagatccttgttgagcgtattgttgaggaggttgttggtattgtgcaggatttgtttcatcctcgcaagctgttaaaaagatacaaccaattaaaatcagggctagttttttcatatttgctttcctcgttttggctattaatacatctgtgtttgaaatctccagagaagcaataaagttgctctccatctcggtataaactcactttactgccgttgattacgcttgtcaatacaaaaattacaacaaacaaccctattgcaaaacaaatattttcaaacacaaccaacaagtatttcattttaaaaatacctcatcatcagtttcattatcccagaagaacaaatcccaaccattcggatcattccatttggctgctggagaagtccatatttgttcgatatcaatattcaaaacttcaccgtttcgttttgaaacagctttagttaattcccaacgagatacaggctctacttcccctgaaccactcccacaacaagctaccacgttaggaggcaaattaattggatctttggtcacaatcataacgcttaccccagggtaaacttttgaaagataatctgaaacgtaatcaacatccccaggtaaatcccaaacaagtttttgaatttcatcaaaattactcataagtctctcctataaaatagcctcccgaaggaggctcatctattaaacagtagcttcttctttttcagggaagataaagcttgcaataacaccaagagctaatgtgcccagaacaatcatcagacttacgttaggggaaatatcatgcgggaggaatgaccacttggcatgaagtgtttcaccgaacggatgatacataagtttagcaccaacaaacaccagaaccacagcaacagctttctctaagtgaaccaaatatttcacagctacacttaacacaaagaaaagtgcacgtaaaccaagaacagccatcagcattgcagaataaactaacagaggttcttgtgtcacaccgatcacagccggaactgaatcaaaagagaagacaatatctgtaagctcaataacaaacacacaaagaagagcaggagttgcatatttaataccattcttaatggtgatgaacttttcaccatccagtgcattgtgcacaggcagaactttacctactaaacgaacagcccaatgcttagagtaatcaatatcctcttcttcgtcaccgcctttgatgatagccacggcagaccaagctacaatcaaaccgaacaacacttggaccgaccaatgcaggttaaacaaagctgttcctgctgcaacaaaaatacctcggaagacaatggctcctgcaatcccccaaagtaaaatcttatgttggagatgtgtgctcttaattccaaagcttgcaaaaattgccatgaacaccattaggttatctacagaaagactcttttccaacacatagccacttaggaaaagcgcggcaaactctttaccatgttctacccaaatgaatgcgtaatatcctaaagctaaagcaatccaaaaaacagaccaaagcaaagcagatttaattccaatttctttattctctttatgaccaaagaaatcgataccaatagacaatgctaaaataccaactaaaacaactacatcaatgattgggaaaccaagttgcattattttctcctttctctttgcggggaaccactccccgcctcatgtgatacatcttactcttttttaaaaccttgtcaacacttattttgaagaactggaggaaaagattccacgcagcactgccataatgaacgctacgcacaccacggtccagaatgtaacaggaacagtgatatctgtgtgacccatcatttcaacaacgtagttgtaagccagcagcagaagccacgctggaatcatactgatcaggaaagccagaacaaacacgataactactgccagaacacctgcaacaacacccatattatttctcctcttaaagtttataaatagtcacatcgtgacctgcttttactaaagtttcttcaatcatcacttcgatgatagcccaattacctcctgccaaccctgctccaatcataggtaaaccaatcttatgttcggcagatgtgttcacccatttgtggagatcctttgccatagcctcaagagcatcatacagggcatcatagtccaactgacgacctttaccgttatacccgtaacggtactgtccgtataggttataaaccagtgggtcagacacctcctccggcacccctaaactaaaagaacccagcttactttgatcacctgcggctgtgtccaagtcggctgcatatgcataaggaaatgctcgtttaatttgcggagcaatccctgcacccatattacacatacagttacaacagtgggctataacgttcacttccccattcttcgctgcatcgatcagattcccagtaacaaccttcaacatttttcctccttacagaatatgttgttttgtgtaacgatccaagaactcaaagttttcagcatactttgcaattcgattgtagccttcagctaaacagccgaagaaaagttgttccacatagtagtgtggcaattggctaagaatgattttgaagtcttcgtgattttggcccataagatacttaataggacgaacaaggcactgtgcatcacgttcttcattaatcattttaacaaacgcttctggtgtattaatataattaaaattcagtttagcttcggtatctgcttgattaccttcatattttgcaaaatacaagaagtaaacatcatttttaacttgattttcatcaaggatctcaatcagtttgtcttcatgagttccagtgatatttacatcatcaataaacacaagcttcttatcaccccagaattctttgttgcagtagaatgtatccccatcaataagtttcttacgactagctttatccaagaaaccataatcgttgatatagctaactttacgatgaataatatccagttctgctgaacgaccttgatcatattgtgcttgcaacatattaaagtaattaataaaatgatctgtcatcattgttgcagcattatgcacatggttgtaaggagaagggatgataacaaattgttccccaatatgtttcattgccacttgagcaaaaaactgaagtgccaattctttacccatacgacgcgcagcttggttactaccaaatttcaattttgaatagtctttgatatcaaaagtagcagtttccaggtcatcaaatttatttgcaaaaatttgagtttgattacgcatttacaatttctcctcttttaagtttctctagtaagtcgttagggttcttaatatgacagaagttaatccctatgtcaacacatttaccatcaaattcttcgctgtccccaacatgtaaaatctcttcagccttcaaaggaatgcttgaatatgtggcggtcctaacaaaaaatctaggatctggtttacataacagatgttcgtctgaaaaatgcataaattcaaaacaattccaactgtcgaacatacaagcacgacgcaaaatatccccagatataaaattagtattgcttttaatactaagatcatatttaccagacaagtatagcaaacaaactggcaaatctaaagcgatatgtggaggaaatttaagaaaccattgctcacactcaaaacgcatttgtgcagattctacaggggttaaacctatctttcttcccaacatattccatgcatatgctacaccttctgcacacccatttagtgcagcattatccataatttctttggcatctttatatgcttcttttgccgcacgttcagacattctaccatatgtagcaatagtgtgcgtacgtgcatctgcatagttttgattggcagaaataagagtattccatacatcaaaagagatatgttttattgtcatactaggcccaccacgcatcaagatttaagttactgtctaccacaacttgttctatgtggtagccttttatctgtatcccactgttcaagagcatatcatacgcttcattgaaacgcaacttatcttctgcggaatataagcgagcattataaaatcggtaatcaatttcttcagcattagaagaaatacggaagaagtttgtttctacttcgggatcacttgctgaagtcttaatgtgaacttctccataattttctttacttagatccatgaaaagaacacaggcaacatgtttaaacattcgttccagtttgtaacgaacaacattgaaacctgcattctcaagtttttctacacactgcaacattaaagtagtgtcgagatcgctttgatactttgttaacatacgatcacgttgagactttgtatcccgatgtaaatcaattgttgtgcatttggcaccaataatcttagctgctttcatcaactcttcagaactaacgttagataaagtaagatgaaaatgggctttccacacttttttagcaggaacaccaaaagatttatccccactattcggcatgttgactactacactatgttgcattacttatctcctcacttaaaatggaagtctttgaagttcatctcctccgatatcaagtaatttagcaacatctcgatcagaaagcaactcttttctttgtaaaatatccacaagggttgcaagaatgtccttaacgtcccgatcactgttcttcaaaagttctcctgccgtccctactttatcccctacagcaaaatatgtaaccatgaaacctcctaagttaatctgattgccaaccacttgccgttttggtccataatctttgattatctgaccctctgaaaggttttgtagttggattgtttatttcatactttccgtctacaataatgtcaacaagatttttaatatacaaaggcacttcctcaaaagtatatcctgtatacaccattatatctttgcttgacccataaacgtctctaaccttttctataaggtttttaacattgtaaatattctgcggatctaatggctctcctcctaaaattgttaaaccttttacaaacggtcttgacaaatcttttaaaacttgctctacattttcgtgagtgaacggtttcccataagaataagaccaggctttttggttaaaacagccacgacaaccgtggctacaaccactaacccagagggagcacctaactccctcaccattaataagatctacaggttcatatcctgcaaaattcaaagatgtttctccctttgcaaaacttcctgcattttacctttgttgtaaggccgtgaattaggggcagaaagataccctgatacacgtctaactacagaaatagtttcttcttcatggttgccacaatcaggacactcaaaccctttagccgttgccttaaattctccatgaaaaccacacttaaagcattgatccacgggctgattaataccaaaatagtgaatatgttcataagcgtagtctactaaagtctccaaagcttctaagttattctttaagtttggtgtttcgacataacttatgttaccaccattgctaatctgtgcaaaacctgcttcataatcccatttttcaaaaggatttgttaccaaccatacaggttggtgaaaagagttggtaagatagtctctttctaccaaacctgggtatttttcatttaaagctgttgcaaacttatagcacaaggattctgctggagttccatagagactaaacgccagcttagatcgttctttaaacacagcacacacatctttcatatgttgcagaatgcttttaccaagttcctttttatctttttcttctggataaaggatttccaaagcttcggcaagacctacataaccaatactaatagaagcatagccaccttcaaacaaaacaccaatttcatcattggcatttaaacgcgctaaagccccttccatgaaaagaatagggttttcagatgctttggtatgcctaatacggtttacacgtaacatgtgagcatcgtaggctatctccatatgtttattaaggaggtcggtgaaagattctcctttacttctcgcttccgcagcaatcagaggtaaattgatagaaactactccaaggttgaatcgtccatcatatttttctccttgttcggtggcatagtacgacaaaaaggaacgacaacccatactcgtaacagtaccatctgctgatcccgtaacttctttgttcaaaggaacagaaataaaatctggataaatacgatcagcacaacatgccaaagcttgttgcttaagatcatagttaggatcactaggtttcatgttaacaccttcttgtaaaaagaaaataactttagggaatacaggtgttacatgatctttgcctagaccgttactatgcactttaagatagttagctgtgatcattctgccaaaaacagaggtatccagacccatactgattgtaataaaaggagattgtccattaacactcattaaagtattaacctgatacaagagagtttgcatagcatcatatacatcttgttcggtcatttctagggcttctttccttgcataacaaccgtagcgacgtttggttatctccatgtttttaaggaaactagcttcaacataaggactaagacctttatcaatgtgcgcacacgtctgacctccatactgactggaggcaacagcttggatgatttgagttagcactgtagtagctaccccaatagattttggtttttctatctgtgcggctccgatcttaaaaccattctctaacatatcttgataattaacaagacaacagtttgtaagaggagagagtagataatccaagtcgtgaatatgtccaaaaccttctgtatgccattctgacaagttttttggcagtatctgtgtcattgccatatgtttgcttaaaatccccgccaagagatccctgtgcgtgttaacgaggtgggaaggtttgtttgcattctctctagtgtatgtttctgaagtgcgatctaaaaaagaaaaaacatcttggtacaaatctttcattattaatccttattttgtgagtagaactattattctacctcttccaaccgaaaaaagctttgaggaaaatcaaaaaaggcgcaaagtgcgcctttaagttttatcatttggagaggaattgtcttcccatgatcttaccgttcttcacagcggtcccatcgtgtccattgtaatcccaagttccatcgatattacgcaagaagctatcacgaacagcataggctttaccgttctctactttactttcttccacaatgattgccataacaagcttattttcaatttcggtagtaaccgattctttgataccctctgtaacttcacgatcatattggatataaactcgctcctcggttacttgcacgtctaccacatttttaaatgtgtaggtctgttgcgtagtgtagaggacacgaacgacactcttcttacctaccggaggcttcttacgaggcttacggtaacgtggtttagggttgttagttggaagccaaccaacaatatcccgatcatatccaacatgaccccaagtgaaatgcgtagccgatccactatccgtagttccgtcacgaaagagaacttctacgtgaccaccacaagggcggtgtccaccattattatagttgtattttgccgtgcgcgggagaatgaagtattctttaatcgcccactcttccagattgtcgatattccaagtgaatactgttcccttagcaacatctgtttgaccattgttgaagcgaacctgcacgaaatcttctgaaggcataacacctgtattcggcagatattcaaatgcagtatcttccgctacaaactgttcttcctcttgctcctcaatacttggcacaggcgcagcttcatcgtatttcgcagcaaacatatttttaaattcttgagccgtgacttctacaaagccgcgatcaccagtagcagcagagtgtgggcgtggtaaatccccaacttcaatatgcattgcatctaagcctgcttgacgatcaaagaagataaccttgcggaattgtttatctttatattgtggcagttcatacatacttggatcgattgtcttcaaacgttcagcatcttctggcttccagaagcttttacctgttgcaaatctaaagtctaccagtagtttaacaacatctcctaatgataaactatctgcatctacgaaaacgtcttcgattcccaataaccctgatttcttaagaatcagatctaacatgtaacctcctgtggtttgttctgcgtctggataacgatcaacactggtgctggttacaccgtttatttcaccagtggaggcattgtaggaaatatatgggaaggtcatatcgttcattgcaaaatcacctgaacaggttggatcatcttctccctcccagccatacaccttcacaataccttcacacaatttgtcatacacaccagcgcgacgtgctgcttcagcaacttcctgtttacgggcaaatttattaatcatgattcctcctgttaattgccatagatgcacgaggttcggctatggctgttgcataaatatatggatgaccttgtggggacaatcttgttccgaatgaccctaattctaaaccattcatgtcttccacgtcaagccctatttctgtttctacaattcttgtttggactttgtagtaggtccagaagaagtatcgcatttcttcggcatactctttcacttcaccaaagctgggatagaactcaatcaactccagcttcaagaagatgttgaagtgagaatcatccaacacttcctctgtgcggtaacatggtgtcagggccatgtagggatgaccagcgataaactcgtagccatccttttccatttgcaagaatgattgctcggcactggcaacataaaacttcccattaggatgccccaaaggagcatcttctttgccaggtggcagtgtgaatgccaaaatatctgcatctactaaataaggaacatctaacatttcagcaaagcgtccataactctggatggcttcggcaatcacacctgtgttcatgaccttcctcctgtgcggaaagcgcgtttagtaatgttggacataatgattaaatcttgtaaagtcatatctgggaactgttgttctaaaactccctcgacagcccctataatatctgacaattcaacaagttgcattattttgcaatcctgctcaacagcatcaaaaagttcttctacttcctctttaatcttttctatgctgccataaggttgtttcttaatgtctgttatgtgataccctgccatttaacgatcctctctgatttgattaatcttacgagcaagggcagctataagcttatcttcttcagatacaggagccgtgctcttacctaaacgatgcatgtctaaaatctcttgaacagtccggttccattgcagacatttaatacaacgtgtatgtgcaacatacagaagatttcgttctgattcttcaagacctacccactcacccttcttatcataattagaaggaaagtcatttgcaacaataacctgatcccattccaaaccttttgatttgtgggctgtagttaaagtaactttagccgttggagagttacggtgcatacgtaaagtgtatgcaatattattagctttaccagaaacaacaatgtttaaaagtcgttttgcatcaggatctgattctgcacactctacaaattcttcccaagaagtgtaaggtagaactgtctcatgcttaactttgtccaaatcacctctacgtaaagcattaacactatcaaccatagaaatgaaatctttggtatctacgttaataataatctcttctccgttagcgattcggtccatagcttcgagcaacagagtcaaattcttacggaaaataatggtgtaaggtttactataatctactacatcagaatgaaaacttccagtgacagtatcataacctttgcctaccagcggatgcttcagaggtgagcgatcagaaaggatcgcattggcaatgtccgcaactttaggaccaaagcgaaaacaagctgtcagaggcaactcaaccccatatgtagccgtttgcttcatcatgttctggcttccacggaactgataaatactctgaaattcatcacccacaacaacaatacgtttagccgatttagcattgcgaaggatagacaggaatgcagggttaacatcctggaattcatctccaaaaataatatcgtatcctaaatcttctttacttaattcaaagagtttcacataggtgtcatgagtcataatggtttctgatttaggatcaatacgctcacgccaaagttgcttcgcatatttaacaacttcattaataagtttttgttcgttgatgttcttacgtttaagatctgacatatgcactttaggaaaatgtttatgtccaatatgttcatcgtcagaaaactcatatttagctaaagtttgttttaccattaacccgatcattgcacgagtcagtagcactttaccattcttatcaatcaaattctgaatcttgaattttttggcaatctcactaccagttccagctacgttaacatattgaccttctggacgagacaatttgtgtcgaaggttttgtggaagacgttggtaacagattgaatgtagcgttcggcacataacgttaggcggcattttacgtcgagcttcctctgccatacttttgttaaacgccaagtatagaatactatcatttgtgccattagccaacatatatagtgttgacgttttacctgatccagatttagcttgaattgtaacgaaacgattttctttatacccgctttcaatagcgtattgttcctcggtaggtgtaaaactcaattgtgtagacacgtatttctcctctcttaataaaaactcttgacaatcctcatcatttccttagctctgctggcataaggttcttttagattaggtggcaaatgtgcattaatgtaccccatttgtttttcccatgtccacttatctttaaatcttggcatggtgtctcctgctaaactgttttcttttcgtgtttgaataatccaattacatggaaaatgcacaccacctttacggaagggaatataatgtcccaatgtgaatgccttattgttctttaaacgtccagctaaattaagattaacaataagactacgaaacacgtagtattgataaagattgtcaacagtatatacagagtagtatgctctaagtgcattatctctactaagattaccaacatccaaactgcaccagtttaaattacttggatcgtagttgtgattatcaatccattcttctctttcctcaaattctgcattaacagcagactgccctgctgtagatacaaaaagagaatttgcatcaaagaacatactcactccccctttagtttacatcgtttagagcattaccaatctttaagataataacatcattaagagcgtcttctccattaaggccagagaaagcaggagtaacgaaagttaccatatagtaatggtcttcttgtaggattgcgataacgccgtctagtttaacatctcctgtgaaacgaaaaactttcaacttttgttctaaaggaagatctccttcaacatttaaaaccatatctccgacaccaaacttttctgccccgatgtagatgtaagcttggtcctcttttttatgataatacagtgttgcttgtttgtcttgtagtgttgtgataccaaacacatctacatcaataatatttttcaaaaaattctcctcttattttgtgttgaccttatttcgcattaacctgtgggatacagagttgcgagatctgtttagaaccttaccaatccctgcatgactatacccttcactatttaacttttcaagaatctggtcttcttcctctgtccagtagcggcgtttagcttgtctatcatccacaccatacatgataggttgctttacatccatcacttttagcaatctgacagcctcttccgctttctcttttttgaaacggagataagggattaaattctcaagcaatcttatcacactttctctgctgctaacattgatattatacatcaaattatcatatttttcagcccaagctacgcgcgatgtgaaagagacagtatatccataactttccaactctttagccaaatcggtcatttcttctgccgatctctcgtgttgtgtaaggtttactgtgtaggagtctgaagtctccctgtttctgcttataatagacccatcacaatctatgcaacctgcgtagtaagcataaaacagttgttcttttatgtccacaatattaacctaaacacatacgtgcgatcagaccttgaattagtttatctgcttcttcccgatcatagtcggtatcttctataccaccatcttcgtcacgataaactttaccttccaggtacccagcatcgatcaaaccaataatcaaatcgaactgccagcaagagttaccgaaagggcgttttccactgaaactatcttcttcttcccaaagtgtagagagcagtcgtctgaaatattcacgcacagtaacagtgccaagatcatcgtcttcaaaaacaacatctaaagcatctggttcagctttctctacaacaggcacataacgttgaccattaataacaacatctacgattgtttctctcatttttcctcctttttgtattcaatgaacatatctgcatagtaagctttacgttcttcaaatttagcagggtttaccacaatgaacaacacctttctattgtcttgtggttctttgactgtaatatataaatcttttgtgcaatagaaacctgtggctttgtaagcgtcaccccaattatccactccacgatctatacgatcaaacttgcagttatactttttatcatccacctggtagacagcttcaccaccataccaagtgaagaattggctaccttccaccccaatcttgaaaccatcacgggcggctgtagcattggtggcaatcatcaacatcaggacacaaagtagccttttcatttagaattcctcttcagtcttctgtcggtttttgaagaatactacgtcatatacctctccgtaaccatcatttacacagaacataataaaacgatcatcttctgctgttggtgcgcgatgttcaagttcaaaactttcaataaaacctcgtgaatttacgtagtagatttcatcctcaccagagaacatccaatccctgtctatcagatagaaagctaaactcacaggcgacaactcatccttcacagaatcattgtacagcatgtgggctgcaactgccaagcttaaagtcggattatacaacattacacctcctcgtcagactcatctgctttagagaatacaacattaaacgtttcaccgcaaccattatttacgaaatacatgataaagttttcatcttcgtctacagggccacggtattccagttcgtagctatacagagaactatcgcttgtggctccctgcggataccagaaatagatctcatcgaaagatttaacccacttcaaacctgtacgatcctcaaacactaatgaggaaggattgtcagcatctttgacagcttcttcataatcctggtggaacttgactgctgttgataatgtgctcattatgcctcctcgtaatgtttgcaaacaacgtgtctccacgtcttcttataatgttctcgcttcgtcatagcttcttgataagagggaatacgctgtaacagaagtctccattcacagtctacgcccatacgtccgtacaaagcataacgaacattgtttttcttgtcttgcatactccctccgatcagttaattaaactttttcccaagtaccaaaagcacaggaagggtagattccaacttgagggtttccgttatcatctttgaaagtaaaactgttgttgtctttatcaagaactgtagaataaatcttaccaacagtaacgcagttggaagcttgacccagttcagtgagagtaagacatttcattttctgtttctttgtagccatttataaaatctccttagtaagtgaatctttattctacacaaagagctttacacatgtcaagtaactctttgtcagattagtcttaatgattggtgatgttgatgacaatcttagtttcaaccttagcccaacaggagtctgcttcattaaaacgactattcacaatgtattctcctgcacgagaacctgttaagcacactgcacctgtatctgtagccaaatagtattcccgttcttgttcatctacttctgcaatgtaatagtagaaaacagacataggttcaatttcagataaacggtataactttggaacaggggatttctcgataaactcaacagaagttttactcatttgttttctcctagatctaaactaattaagaagtcacgaaggatgatcatttgttctgtagacaatgataatacaccttctccataaatatcaccagaccattcagcagttagatctagtgtaccagtaccaggaaaccaatcaacagtgatctgattaccattagagtcaggtagtatttcactgactaacataacacactctcctattattgttcttgatcttacgatcatctaccgataagaacaagtacttaaatctctgttcttcgaacatctaacgatagagattaatctattacataatctatactcgctatcgctcgacccttcgggggttagggtagcatattttttgaaaaaagtcaacacttattttttggtaagtagataaatcaattattcacctgcttctggtgcatatagtgctttagtatcgaagtcaaagaagtgagtgactcctgttactttggatgcatgaatagataatcgtgcaagcttaagcagattatccatttccgcaatctttgcacgaaatactgcacgtgtagcgtcaaaagctgcatgtggcatgtatttacgatttagactactacgtttaaatttacgataatctgcaatgatcctgttacgttctttgttcaagtgcttgaccagtgcagtatatacatgtggttctttgttagccattgttaatctcctcttcatatgttggtagtgcatggtatgcgatcacaggtgccaagtcaaaataaaaatgaccattgataacagctatcgtgccattgcgtgttttgttaacttcacagaatcccttcttgccgtttgccatgattacaagccactctccgataggaacatcctcggtgccagatactttaatccatccactcactttacttcccctttgtaatcggacactataccaggtcttacttttgccttaagatgtttcaactctgccataggagttgccacttgtataaggttaataatttcaacctcgtagatagtatactcataacccgcatacttcccgatggaatgcaggtatttgatagcatgttcaggtgaatctgcttcaacataccccaaatcttttgtagtgcggccttcacagtcgccttctgtagttacgtgataaagtgtcataaaacctcctcatagtaaggtaaagccttgatcagttgttctgaagtgccattttgcacccacgtaacacccttgtcaagagaaacataccctttcttattgataaatttacggagacaaccagtgaacttgtttttgtagatcatttcttctttcctttctttaatttgttgtgacctttacccttataaagcttgtgattacgagcagacgggttattttggttctccagtcggctaacaggtatattccaaaggtttcctgctacaaaagatgctgccacaagttcttccaggtatacaaaatccaaagcaggtatctttgtttccctcatctcgcgttctacattagacaacacgccttcttccttactgtcttctttttcaattacagaccaaccctcttcctgccaagcttcccctctgaaccaagtttccatgttataaccttgttcgtcgagaataacaccatctcgcatctcaaaccattcgccaccacaaaaatggcggtgctcaacacgtctaccttccttcattgcttctttagcttcgggccaagtcagtttgatgttttggatgttttgcatttgttttctccttttgtttggtaggagttgatcttaacaagattaaaaagtatgtcaatacttgatctgaaattattttcaggtatcatgtatgaacattaacaagagaggtagatgatgaacattactttagcaactaagaatatttctgaaacaattaacggttttggtgtgattgtagccttgcacggtaacaatgagaaatggttggcttcttttgaagaggatcgtcaacacaacattattttagatgcccctataaaagttatgcatatcgttggtgaaagcaaagtgctcacttcctcccgttcaaaagaacaaattacaaatgaattagtaaaactgcttgacaatgttcttaacatgtttgataatgcacccatcgatacaaaacgtgtcttaatgtgagaggagaacaaaatgtactattcacaagacgaagtagcaaacattaaactggcagtgggagatcttattgtgtcacctaactactattgggataacagagatttggttgaagtagtaacccatgttggagttgaaggtattgtgctctacacactaggtggaggtgttgttggggaaatggaacgttatacgacaacgaagaaactggtaagctcttatcacatgtttttacaccaaggttcggaagagtatacagctttcttgttgaaattagatgcagatcgggagaaggcacgatgaaaattgtacacgatgaaattcaaatagaagaaagtgacctgatggatttggatgcagttttggggaaggtaatctatgcaggaattaaagccttccgtgagaaggcaaacaatagcacgtttgtcatgatccccactaaactgatgcgtgttttgtatccaaatagaagtgcgccgtatacagatgaagaagaggagacaggtagaagagagtggttaaatattttagaaaagatggagaatgcttttattgatagtggtaatccagaaatcgtgtatgctgaagatcaaaggaaggcacgattagaaggccgtcttttattcactagttattttgataatctttggagctaaatatgtctgaattcttcacaatggctttcttagggatctatttgattattagtgctgttggcttaatcatgtctctaatagaggaaatgggaattaagtggaattgtgcattcggtatagctcttatgctcactccagtttggatttacatttgcaaatcggttgaactaattggttaatggaggtaatatgtttagtaaagagatgagagaggtgatcgctactctagtagttgatcatggtgttgaagttgagcgtcacgtttggaaagatgagcctcctttctttgatttggcatcacgggctaaaagtcacatgtatctccttgaagatgataaggattttattctgcgtatgcgttatgatcgagagtttagaattcctcttgacacagatcctgatgatgtagtattgtggttggcagagcatttcgcatttaacgctctacatggaagaagttttggtaatgaacgttgggatactatttgtcgtaaacataatattgaaccagaatacgggagtatgtaatgttaagcgttaagcctaagatgatcagtgaagaccagaaagacttcatttacaagtgtggacgaatctggagagagtataccaagggtaacgaggtcgtggtggttactgaacaccagattgaaatctctaatcttttcggtgattatttgcaagtgatcaaattaggcattgacagaggtttggtgcaggtgttaacattatcccaagttgaagcagaacacttagacaaaatcattgtcgagttctaagaggagaaagaatatgatctctttagaatcaatagcttttaagaaggggtataccgcagggttcaagtttggtatgtttaataaagtaaatccatattgtccaaagacacacaaaaaggaattcgaagaatgggaagatggattttctaaaggctatcaggcaaaaggttggttgtaaggagagaatatgattttaaacttcatcatcaacttgtgtttgacattgggattactctgtgcaatagtatcccctctggttggtgaatattgttctgaactggcgatgtttatagttcttggcgcggctattgctaatatgtttgtcgctgcgatttgtatgttgtgggaataggagggaagtttatgaaaaaactaatcttagccatattgctggctaccgtaagcttcaccacttacgctcaaaaatttgtagcagttaaaacagatattggtaaagatgttgtgatcacaggcaacaagttttactatacacctgggaatggtgttctagaagagtgcaaagatgttgaggcatatacaggaaaagaagataacacggaacgtcctttttattcgattatagctacttgcaaaaatgaaatagtagctattaaacaatacaaagatgcacctggaggagagtacttattaatcaagaatattaagagtgaaaaactgcaaagtttacagtaattattttaaaaggagaaacgttctaatgaaatacactatttttggagatgtggctgttgtaaataaggaatatggtgttgaagctaataaacttcctgctggagtttgggttgtcaactgcgatccgcacggtaactactctttagtgcgtggcgaaagtttctctcttccaaacactctttatggggaaactaaagaccgcgccgcacatgttattaaaacatttgctcgtcgtagtaaagaaggtaaaaatactggggtgttactgacagggacaaagggcagtggtaagacgatgttagctaaactgattagcatgtccctaatgtccacagaaggtttaggtattccaaccattttggtgacacagccttacacagatgctggattcttagaatttatgagtaaaattacagatcgtgctgttgttttatttgacgagtttgataaagtgtacgctaagaaagaagatcaggaagcactgttgaccttgttggatggaacaggaagtggaaataaactttacatcctcactaaaaatagtggctatatctcggaatattttgtaaaccgtcctagtcgtatctactacagtttcaattacgataaactgtctagtgaaactatgttagattacttggataagaacttggtaaataaaaaacacgtagataacttccaacgtttatgggatgttagcacagagttgtctttcgatgttattcaaggcattgtagaagaattgaatttctatccaaaaatgacttttaaagaatgtcttgaaatgatgggtatttctttaggcaatgatgctaaatggaatgtggcctctattgtagctaatggcaaaaccttgaaggtgaattggatcaataactggcacgactttacccctactaagtttttgtcgggtgcttgttccttgaacatctatctacaaagcttgaaagatgatgaagtggaagcaatggaaaccaacagttatgttatcctagacgaagatggcgatccacatattgatctatgtgcaactgctgatggtctaacttgtgatctgattgaaggtggtaagatcctggtgatgagcactacaccaggaaacactctgcgagtggtgctggagcctgtaacacaacgttccaccacattaggtagcgtgttctaataagttgagatttattaaacccgcttcggcgggttttctcttgtatggatatcagattaataagaggagcaacagatggcagcaccaaaatcatgggaacaatataaagaagagtgtcaaccaatagcagagagtaagcaaatccaaatcttaggatggacgggagaatggaaaggggttaatacaaaacttgatttgttgtgtcattgtggttataaatgggatactacaagtattaacagttttaaacgtggtagtggttgtcctatgtgtgcaggtcaaattaaagatttaaaaacataccttactgaatgtaaaccaatagcggaagctaaggggattaccatcataggtatcgtagaaccgtttaaaggtgcgcgtacgaaaatgatgctacgttgtaggtatggtcatgaatggaatacatgtagttttgatagttttaaacatggcagtggttgtcttatatgtaggtatgagaacacaaggaggtcacaaacaatacccgacgatcaacatattgcagatttcttttctacagggaagtttaaggaaggcactattttcaccaacacgggggaacgtaaagggtgtgatccagtatggatggttcagtgtcctgtttgttctcatgatgaatatgttaaagctggactatgtgatggtaagttttatatgacgcgtagcaatcttaaatatggacacttaccctgccgttgctctgcatcttataggtatacagcggaacagattacgtataaagtaagaaagaaaatagaaaagaaagggtatgtttggataggatggattaccaaaccatcttctataggtaagtttaaatatgtatgtaagagtcatggggaacaaaaaggaactgcaaacaaccttttaaacataggacaaggttgtccgcagtgtgctaacaaaaatcaacaacaagcctacattaattatatttacgatgagcaagatattatctgtgcactgaagtttggtattgctaataatagtaatcgccgtatcaaagaacaaaatagtcgtaatgtgtttactatgaaacagggccaagtgtggcacttccctactgtgaagcaatgcaaagatgcagaaaagcgttgtaagcgtgtccttcacacggaagcagtgagcaaatatgctatgccagatggctacacagagacagcggagttatcttgcatggcatcaatacaaaacatttataaactttatggtggaacattacaggaggaaacatgttagttgacgttcaaattatgcgcaacgaaaggatggatttctttgaagcagtagagaaacatctgatccgatgggactatgaatttgttcctgctggatgtggaccagtagagcatttagcggaagacgacgatgtatacatgatcattcgtcaagtgtaccagacagaccagtgtgaagaaactcccgaactgattttgtttgagtgtaaagatcttgcaaaatattttgactatggcggaaaagagggtcataatctctccagatacaataaacgtctacttatcttagactacatgcggaacaacaaacacaaactcatcgacgcagacgcagtttatggctactggtggatggattaacaaaggagaaactatggcacgtttagcagataaccctgtattctaccccgttcttgatctttatgatgaattgacatatgttgtggagcggtataattacaatgaagacctcttggagacaaaccttaaagtagttctgatgaaagcctatcagcaagggcaacgtgaaattttggagagtatgaaaaatgcgaataactgatgaatatgtattcttcttttcacataaagatgtgtttagtaattggtatattgcaccctttacagaaaccgaaccaggttacaatcagacatttaattgtgtcgaacaatacatgatgtggcgtaaagctttgctttttaatgatcacaacactgcacaggctattctgactcatagttcgatacggaaagatgagaagatccaagcttattacaaacgtatgggtagggcagtgtcggattttgataacaacgtatgggaagagaaccgtgagcgtattgttatgcgaggtttatgcttgaaatatgtacagaatccagatttgtatgcagacttacacctttaccaatacaaaacgtttgttgaagcaagtccttacgataaggtttacggaattggaatggggatgtatgaaccaggggggctaaaccctgctacctggaaagggcagaatcttttaggtaaatatcataacaaactgatcgaaatacttttcccagacaaaataccgcaaagacgatatttgtgatattttaacttttttcatttttagaacaaaggtgtcactttgtagcacagaaataaggctcctacagcaccgtagagagcctattattttgtcctatacaaacccttgtctttttcagtttgcatcactaagattcgatctaggtgggttcctgaaggtctactaataagattaaaggttatatcaaattcccactatccattatctcaaaaatccctcaaattatttaaactttttaagaatttacaaaagtgaaagttgaaaaccaaaatttaaagtttaggaaaattatcttaaaatgttagatacaaaacaaaactcaaaaatcaaggaaaattttaaaaattttgcgcgcccacagtatttaaagtttttttgcttttacaaaaatgaaagtacaaaagcaaaatttaaagtttacaaaaatttttatgcagatgagaatgagaagagttctcatatggaaatgcaaatgataatgattcgcatttaagtttataaatgagattgattcttatttaataaggtaaatggtaatcattctcatttagagaatgacgcgcaggggtggtgtttgtctcgcgctcccgtgtcccctcgccatgtaataagaataacagatccagccaagaaagcaagcgattattttatctttacatttctttacaaatatatagcgcccagcctaccggcgatcaaccttccaaccagtgcccctggtatgttagccccgcctttacgccgtgggggtggcgtttcctcttctgtatgttaggcattataagcccaatccctgggcttgtcaaacattttcatctatttattttcttgccaggttaggacacctaaccagaaatggcagtcacctttcgcccattgtggtatattgctttctttcccaccttctcgcgcccaggaataaccgcccgtgtaactttgcaattgataactatcctcgaccttataatctgacaggttgagaactgtttctacctttaagcccgttgcgctcgctacctggtgcaccgtgccgccttgccagcccaatgagtgcataaggtgtaatgtagtatttgtcatggtatcgccctttctttgatgtgcgccctggttggcgcggtagaaagatgatagccctttcttttatatatagcaagcaaaaagaaaataaaaaagattgaaaaagtgattgacgttcgccaggtggcggcataatatttaccacgtagggcggcaatggtgccgctcattatttggagttaaaatcatggcaacattgcacattgtggcgaaagctggacaaataaacgtggtagtaaacggttttactgagttcagtcatccccaggatgatcatgaaacggttttatctttcattgattcactgttagaaatgggagtaattacagaagaccagcacgctacaaaatgcaaacgcgttaatcagattgcaggaatagaataaaaagtattgacaacaaacaacaacctgataagatgtatcacatagggcggcggaatggtccagccgccaaaacagaagagagattataatcatggcatcatatagcgcaacaatgatcgtagctggcaccactggtaaacctatgagcggtggcggatctttcgcaaatatcaacattgacgggcgtttatccctggacgcagcgatcaccgtggcgcgggaaacatttaagaaagaatgtaatttcaacaagcaagattatctcggtttcgctattgaaaaaaccgcgcgctttgttgattataaaagcccgaaaatggttgatactacactaaaagcgcaagatgtagcgtttttgctttaaggcttgacattaacgaataatttgttaatatgttacataaagcgggaatagttcccgctatttgtaaggtggtagaatgttttacatcaaattaaaaggtcacgtgatcgcgttcaaagataacgctttttacagattagcaaaatatgcgttaatacatccccactatgtttatataagggggcgtgatgaaataaatatctttgatcaaacaacatgcgagaacatcgagatccgcaaggttggcgtacgtgattatcgtacatctttctacccttgcaaggattcagcaagtctttttaaagtatgccaattgttgaaaaaaggtggttaatatgggccgcgaatatgtgatccagtcttgggtaaaacatgaagcagatgatccgcgcatcattcccgatcatcttatcgatgaatccacgggatatagcggtgagcaaataggtaacagattagcatgtagtaacggcaacgtaaaagcgcgttatgtgcgccctggctggctggcaaatggtaacgctgatttatccagtgcggaagatgcgagcgacggcgcgaaagataatcctttgtacaaaattgatccggcttttcgtgtcctggatgaataccccagcaagatagcggcgctcgatcaggccctggaaagtaagcgcatcacctggaccgcttacaacatggcaaaaaacgtacttgatggtaaattgattcaagccgaaagaaaattagccaaaattgcagccatagcccaggaggaagacgaggagacaacggaagaggaagagtacgaagagatcccgccgttgttgtgtgttgatgcttttcctgattatcagccgacagaggaagaaaaaaggatcgcactagaaaactttgaaaatagtctttgacatatcgccgccactggcataatatttaccacgtagggcggcaatggtgccgctcatagtgaaattatgcaagaggcttacaatgattaataaagaaaatagcttgacggttggaacgattaacgctatcattctagccgttccattttgggttgtagtagcggctattattttctaaaaatattcttgacaacgttttttaatctgataagatgtatcacatagggcggcggaatacttccccgccaaaacaaaaaagggtaacacaatgagcaagcaaatcaatactatcatgtttaatctggtatctttccgcgatgatatgaaaaatttaccacgtgaaacggttgatattcatgtttcagcttatcgcgcccttattgatatgttaccgctaaaacgtgatcaacatgccgctaatatgatgcttaatgctatgcttaaaaagatgattcaaacggatcttactctggcgtatgagtatcaagggcgcttatatgcgacttacaacaaagcggtacctggtctgggaagtaccgaagagttgcacggcttaaacctggatcaaaacacttgggatagtatgcgccgcgttatggtatgggccgaaagcggtaaaatttacgaataaaaacggttgacactgtttaaacttctggtatagtttatcacgtagggcggcaatggtgccgccaacaataaaaggttaacatcatggctatcattgcaaaaactgagattataggtttagattcgatcctcctggcttatgaggaaactttaaaaatgtatgtagtgacctatggtgattatgtgcgtgaatacgaatacattgatcttgcttttgaatgttacattcgccaggtcaataaagcctataatgattatcgttaaaagttttagtcttatactattgacaatgagtgatagtataagcataataacttttatcgggaatacttcccactaaccaaaaagagagagtgacaccatggctattaatatcaatgtttccgcttatgctaccctggctaacacggctaaaattgaattatccagcattgaggcggtgcatattagcgcccgtcgctggtttcaacagtcctacggtaacacatatttttctttaatggttgacgttgagatcggcggtaaactgatcgaggtggttaacgttccgtttcaatatggctatggtgatcattttgataccgtcgccctggaagaatttagcaaggttatcaaccttgagggcaaggaattttcacgcggcgcgtatctttcccgtttttgccgtgacaatgggatcactgtatacagtcatgcaagcgatgtaaaacgtaaaaaagatttataaaaagcattgacagcacgaataaaaagagtaaactgtattacatagagagcgggaacacttcccgcctcactgaaaaagagagaaaaatcatggctaaatctaaaatgtacaacggtcacaaaaacaaaactcattggaatgtaagcctgtggattaataacgatgagggattgtatcggtttgcattgggattgatcaatgagtgcggtaataaagatcaggcggctgatttaatgtgttaccgtttgaaacaggatggaatcactacaacgccagacggctttaagtatagtaaaactgcaatccgcgccgctatggttggaatgtaataaaaacagttgacaacgtttaaaattagtgtaagatgtatgacatagggcgggaagtggtttcccgccaacaacagagagattaaagattatggctatcaatattgttcgtgtatccggcaccgttggcagttcccaggttgtagcagttgtaacaaacaaaaagattaatgatgtatgtgagatcttgaataagtgggctattgctaattttggggaatatgcaagcgttgagtacatcgaatcctaccaggtgccgaccatcagcctaaccgatctcaacgttgatcgcctgttatgcctggatgaattaatctgaaaagattgttgacaccggaaagaaaaagagtaaactgtattacgtagggcggcaatagcgccgccacatcaaagagagaaatcaaaatggctaatatccgcactttactgaaaaatgcaagtcaagttttattttcagatgatgagtatttcaataaagacattacaggcgtgaaaaatttaaaagacgtgaaggatgttatcggtattcgtggatctttacgtaaaggtgactactatggtaacaaggtgcaatataaactgtcaaaatattatgattttactttgacaattatttcataaaaccgcttgcaatcttaacaaaataaagtaaactgtattacatcaaggctgcggaatggtccaccgcctaacaaagagaagaggaaaacatcatgatcacttttactacccgtgaagccgctcgcaacgttgcccgtaaagttaacgccgccaacctgggcgctacgcttaaagccccggtaaaagatgcatcaggcgcgtggatcttccctggtctgcgtcacgctgacaagttaggtactttaagccttaaaaaataatcgttgacttttcgttatagcgccttataatgggcgctatagagaagagaaaccactactaacaaggaaacatcatgatcactttcgctattgtcgccgttgtcgctggtcaggtttacgtaaacgatacattcaccacagaagacaaggccgcaggagacataaccgccgtttacaatgagtgcaaggcagtagaaaggatgttagcgccttgtatgttaatgagtgaacgccaggacgggataacagtgtttactaacattgaaacagggtaccaaatggtagtaacaaaataaagcttgacacggatttaattttcagtaaactgttacatgtagggcgggaatagttcccgctaaaaagagagaaagaccatgaaagcacaaaatgcaattaaagagtacatccttgccgctatcgattttaatgattacggtattacaaccgaaaaagagaagatcgcggaattgatgcgccgttttaattccgagtactggtaccctgataaccaatcacgttttaattatagtattgttaaagcacttgcatcatggttacaaggtttgccatcagatatcaatatcgctttcgaatattgggaaattgatcgcttgttaacatcctggggatacattaaagagaatagcaacgatgataaaatccaacgagaaagggaaaattattggctttatattgcaggcgtgatccttgcttgctcttatgaatgataaaccttgacaattttacaaaacagtttaaattaacaatatagcggcaatggtgccgctcatatgaagaggaaacaaaatgaatacatctaatcgcgcagaaaaaattcaatcttccaagatccgcaaggcctggaacgaggaagtgatccgcaaaggcgacaagcgcaataaaacaaagcgcgggaagagtgacaaatataattggatggatttagaggattaacataacaagggcgcaccaagcgccctttctttttatatgtagaggataaacaaagatgactttaagcgagcttaaaacagcctacaacgcaacgttaaaaatagccgtgcgttaccgtgatgcgtacggttttatcgcgcagggcgtgatcctgggcttttctgacgatggtttgatctatgttgatgcacatcataacaaggtaaaacctgaaaacgtcattagcataaaatatctttaaaagtggttgacaccataaccggacctgttaaactgtattacatcaagcggggaatagttcccaccatacaaaaaggtaaatattatgatcaccgcaaaacaagaaaaaatcattatcgacgttgcagccgttgccgctattgctattattggatcttattatgacaccgcgcgtccttcctccttgcatgaggtcgccgccgttgcatcagttggcgtactgttttacgttggtaaacgctatttatcaccaatgattaacaagctgacaccgtggaaaaataaaggttgatcctgttttatattgtgttatagttatcgtgtagggcggcaatggtgccgcgcccctttgaggatgcaatcatgagtaaagctaacaccgtgctaatgttttccctgattaatgatcccgcttacttgtccaacatggcgcaggagggtaacacattaacggcaacattcaccaataagcttgaccgagtgatcatcatctcactgaaaacagttagtaaaggcttttactcgttagcttatcattggatcactgataccgatgagacaagccaggattatagcgcccctttccctgaatcaatggcacgggagatcatcgcagccgttgtaaatgatggtttgtttactgcataaaaatttagaaaaaggcttgcaatcattttgagatagtgtatatttaattcatagggcggcgggaatagttcccaaagcaaacgagaggattacacgatgagcaagtacacagtagaatacacggtagagaatccggcagtatccgaaggtaaaaagatgacatttgccatcagtataatcgctttcgttgtcactatcttatcaatcatcttataaggtgcacaccatgaaaacaacagatattatcaaagagatcgcccttgccgctgacgttgagatcgaggaagtgatcgcgctcaatcttacagaaaacgatctgcgcaactatgaagcggaaagcgtgaaagcaagtggcgcggtcctggcatataatccggctaacaaatagtttgacaagctgaatcaacctgataagatgtatcacataggggcgacaagcgccccgcctaacagaagagagaaaaaatcatgaccatcgttaaattaacaaccgaagaaatgaaaacaatgttaaccactaatttacaaaattggaaaattggtgttgacgttgaaacagtgtgcaagttgaacgacaaactaacaccggacgacattgaaacgatcatccgtgcagatttctatgatgctttatacgatgattccacagtccttgaaacgatgttggataacgcttggatcaatcccgatttggcggcttatggtcatcttgcctttgaagccatccataatgtttataatcgttaagggggataacatgaatccgaaagatatgcaagcatggaaagggtacgacgatctaagcgccttgcgcaataagtcaagccgtaaccttagacggttggaagcaaagaaaaagaaaaaatagtttgacaagtccgcctagtctgataatatgtatcttgtagggcggcaatggtgccgctcacaagaagagagaaaaatcatgaaaattacaaaaagcctaactaattatgcagcacgtcgcggattatgtttaaccgttgaaaacttagggaaagaagactttttgtgtttttgggagcttgaaaatgattgcgagtggatgttttcttattctatctgcgaagatcaaaacggttgtttgttaacctggcgcggtaatatctatttaccggaagaaattaaagaagagttaccaggtacgatcatgacagagagacagcttaaggaagtgatcaattttgtagggcaaaacattaaaaaataatttgacagtaggcaaacaacgtagtaaagtttattacatagagcggcggaatggtccaccgctcacaacagaagagaaacaaatcatgatcccgactatgttttatgtatcgcgcaaaggtcacaatattttttggtctgaagatttaaatgaagctatgacgtttgcccgtgatcgtgttgctatcggtggcgttaatatcaccgtaaccgatgaaaacggcattgaatactataacggcgacgatgaagagtaatcaacaaggcgggattaatcccgcctgtattaaagggtaatataatgaaaactttcaacgcaacagcctcgacaattggttatattattacagtgcaagccgttgacctggtagcggcagcaaacaagattaaaaagatgatcccaacaggcagcgaattttccgtttgggaagtaaaataaagcttgacaataatttgttatctagtaaagtgtattacgtagggcggggcaatggtgcaacgcctactaatgagggtagaatcatgttagagaaaattttcacggttgtaatagtgggcctggcgttatcggttggagtggttgcaactatggctaacatgatcctatcttcccacggtatcggttaaggtgaaacaaatgatcacgaacaaaacaggcaaaacggaatttttacgcggcttacaagttggtaagtctgagatctggcattgcacgaagtccgcgcataatgaaatgaaagatttcaccgctactttacaacgtgttaaaatatctattacacagaaaaaagccttgttagtagtagaaaacgagatcccgcaaactattattattgtcgagcgtacagcatgaaaacagaaatcattattgaaatcatcaacggctataaagaagcctttatttttgctgaatcagcaagggatcatgaaggtaattttattgataacttagacgattatgatttttctcctagcgcggatcaacggatcgcccaggatgtaacagcctttattaatgctaatcttgccgctatctctgaggcaatgagcgacggcgcaacagccaaccagatcgggaatgatttacattttacccgtaacggtcacggcgtaggcttttgggatcgtcctgaaatatacaccactaacacagccaaccgcctaaccaatgcagctaagtttatgccgaacgtgtcggcttacattggtgaagataatttgatttatattgaataaaaagtattgacacagatcgccagtgtgctaatatttaccacgtagggcggcaatggtgccgccgataatgaggaaagtaaaatggaaactatcgctattgttaccgtagaaaagctggttgttggtgatgtattcgcgttaatggtgcctaacagcagcaaactgggcgcttatgaagtgatggatcataaaaatgaatcatttggcgacggttgcacaatggcggtaaaatctttaaaggatggaatcatccgccaggctaactggcacaaagggaatcaagtcggtttaatatcagctaatttcttgccagaagagcaaacgttagaccaactatcaggcggtaagacgttagccgaactactggaaacagcgatctaatcaacaaaggggcggcaacgcccccacatcagaaaggaaaagattatgagtattgcaacagtattaaacgccgttaaaaccgctgaatcatccggcttacatgttgagcttatagatcaaccaggtggcgatctccttgtccaggtttacccgccgaaagtaggagatgattattattggtgctattctgatacgttcgaacaagtagacacgaaagcgatcacggcttttattttaaaagctattgaagaaaataactttcattataacatcaatcaataaaccataagcagggcggtaacgcccaattaaacgcaataggaagaggctagaaagcatgaaaaagatgatcgcagtagttgccctggttgttggtattaacgcgcctgtactggctaatgagttgcctgaatccatcacgttaaccgatatcaacgcaataaaccggatcggcgttaattatcgcctatgccttgccgctaaaactttccaggacggcacgacagaataccacggattcgagggtatccgttgcggtgagcttgcacgcgaccttaaggaagatccagaccttgaggccataccgatgaccgtaaacggtaaagcttacgtaaaccgccaacaatgagaaaggtaatcatcacaatggggatcgtaatagcaacgctggcgcttatccccttcatggttgaacatgtgctgatcaatgttgtcctggtagtcagtgacctattggaaacggttggcaactggttttaagataaataaacagggcttgtttttgtcctgttttttgttatacttattgaacgggcggcacctggaagcaggggaagataatcaccggaagaccccgctatatattgatagctaacatctatcaaacaacaaaacatcaaagagataaactatcaaatctttacaatcctacctattgacaccggatcacgcttacattatcatttatcacgtagggcgggaatgtttcccgcctgatttaggagtcatatcatgatcgaacaaattaaaagcactaaaccaaatgttaacggtaatgtttctcactttatcggggataatgaaagaggtacaccgtacgccgccgtaaccgttcaaccgaacggggattattggtttaccgtgtacggatcttactcttttggacgttcggcacatgataagatcttgcaagtggttaagcctactgggaagaatatcacagcagaaaaattttataaaaaataacttgctttatagctcctgttaacttatagttattgcgtagggcgagcaatacagcaagcccacaaagaggaaaataaaatgagcaaatcagcaattaaagcacttgaaaaagcacaagaagtgatcgcaacgtcaaccactggcgcaaaggttaatcttgttggttatctgacagatgaaactatccgtaaaaattggcgtaatgctgatttactggcttgcttattgattaatagtgtcgctaatgctttccagtgtgaaacagccgagagcctggaggaaaacttgtttgataatatggatcaagccattgaaacctatatacaatcaaacatggatagctggaacagtaaaacatggcccgacaatttacgcgatacaactgatcaactgatccgccttgccctgatggttgaacgcgataacgttcacaaccgcacaaagtaagattatacaagggcgcactaagcgccctttaacgtaaagaaatgtaaataatgcgctatcccctattgacaggggatcggcgttatattatatttaactcactggcagcaaacaacgaaacgaaacaaaggacaacaccatgaacattaaatcaaataatccagcttactccttcgataacgctttttgtcacggtagcgccgccaaaggcttcgaaatcgatggtaaattggttatcgtgaacgttgacggggaagaggttgcagtatatccagtaaacgatgttaaaagccgtttacaatgccgcatggatgttaccgcatatcagcttgatccggtccgtgtagttgccctggtattagaggaagagatcaaagcaatgcatcacagcaataagtttattggtgacgcgcaggataatatgaacgtttgccgccataaagttaatgaagccttgaaagaatgcggttttaaggatctgatgatcaaacgtgatgaaaaattccgctttcgtaatgacctggcaaaccggatctactcaatctatgaagcgttataattgacaacaaaacaaggggcgcactaagcgccctttctttttgcctgaataatgttgatagattccgcctatggaaaaccgacacagaacaaaactgaataaatagcggtatcgagctaatcaaccattaaatgaataaccatacctcccagggtaacaggctgttagagagccatttaaagcggttaaaatcgatcaacaaccaacaacaaaccatcaaaaacacccttttacctcctttctggtgcaatgataaccattatcatctatctatgtttatctatgcaatataagtgcataactataatgttgataatagttcgcaacaactaactaaccaacaacctaaaacaacaagcaaactaatcataatcaaaggaataatagcaagatgattgataacgacaaacaatcaaaccatgatgaatactaagcaggataacgataacacgacaaaacaaccaactaacgaacaataacaaacgaaaccattaaaagattaactattagcaaaatagtgcctgaatgaaatcattacaaaacgaatcattcacaggatcatcattagcacgctatgccggacacatagcgagctaataataagccaactacaccccaacaatcataaccatcggtgatggttatttcttgttactgcgtagcttgcaataattgcaagcgtaatgacgcttacacttattgcgctggcttattattagcattatatgtaattaccaagatcataacgttagcgcaataacaataatcattgtggtaattacgtaaggaaacaattagcatggcaataattatgggggcaatgggaggatgattatcatcattccgatacattgcacactatgcacataatagaataaaagtcaataattttgggggcgaaatgttaccgccacaggcgggaatgttgagcactaagagaagagattaaaggaataatctttcgggggcgaatactatcgctacgcgatatgttgagcatcttctcttaaacgtaaataaaatcagaaaattcttgatttattttagtttatatgttaataaacgtttaaataataatcattctcatataaataatagtctgcttgtcatgagcgggattagttgacattgttccgtcatatgatgaagttgccaaaccattgataaataagtgtttgtgtgatttataatcaagtggtccaccttgtcgctacgttggcatgagccttgcataagtcattgaatacgaatgataattattctcattcgcatgatatttgggaattgtcgctgcgtggacctgacggcccgaaaattcgcgttaagcacttcttacgtatgcgccatgatttttgccatatcatgttgattctattagatattcttgccatgatagccatgaaacatggtgtcccgaaataatctctccccgtagatattttgggttactttttatacaagagtggggtgtcaaaaataatcggtatatatgggataattgataggaatcccctatgataattcgattgtaattccctaagattgatcgtatgatgttggtgattgatgattgccatgaaagatggctaacgatgagaggagattgtcatgcaagagagtaaaaatgttccgttaagtagtgcaacattgcttcgcttctataaagcatggattgccaactatcctgcaatgaatcgcacaacgagtggcttatgtggttgtctggtagattatgtagatgattttgttggtgagacaactagagaagaagatagaaaatggcgtgatcatttgttagaccgtttgaaatatgaaatgaggaaacaatttacatgtgcagggctggactacaatcttccgttcaatgcagattgcatggattacctttcagagtgcataaacttggcgtgtcataccaacacgttacgtcttcagtgggtgaaagatcgcattgaagatgcaaataatgcttgcattgaataaagatgtttgtataatggatgacataacagatagccaatgaggagatgaaatgaagaatttgaaaactgtcacaatgttcttgactgatcctacacgtgtgcaagcactggctaaagccagccgtgtagctgtagaattccaaaactttaagccgtccgttgtgacaggcagtgaaacgtgtgttatcgatttcattaacgaatacttccgagggaatccggttggtcgttactttattaagggtctgaaggatgcataacatgaaacgcatgaaaattcgtattgagaatgatggtggttataaaggattggcacatgcaaaatttccacttgtgttggaagctactgtggaatacagtgggcttgctcatgtgcgattctcgaagatgatggaagtgcaggaatggttttgggacgagatagatgcacgagaaggggaagattatgttttctttcctcacgaatatgaaattgtctattaagggttgtgtgcaatgatcacaccacaacagaatgaagcagcaatggatcttctcgatagtttgtatttcgataattggtactctgaatgtgaatggatgaatatgcaaactctgaaagagaagacaaaagcgttgattacagtagatcaatttcttgcagagacggaaagaatgaattatgatatggcatctcgcgcacgacgagtttccattttcaataaaatgttggcattagggggaggtagaaaatgagacaattcactatactggcagcttatgtgcaatgtgttcacgattatgttagtgctcatacaggtttgctggaagttaccagtaaaattgaaggtaatatgggtactgtctgtgtgcaacatactttatccaacgtgccgtttaaagtgttcactgttgtagctgctgattacaatcgtgtagatgtgcgtttcttggatcataattttcgtaacgcactagataatatcgaagattatcttcccgtgaaacctttgtcatttccgccgagtcgtgcaaataatgtagtgacaaaccttaatgaaaggaatgtggctatgcacaaaaaagtccgtcaactgaaaatgctgatggaaatgcaagaagagattgaaaaagaactaaaagaagattttggtatgcttccaaaagacgctttgaaatggtatgatgaactaggaggagagagcaatgtttaaagaaggtcatgtctaccgtttccaggatgaggattatatgcgactatattctacctttgataacagtattgcggctatcattggagagaattttttcgaggtgttgagcactgatgtaaatggtaatatcttgtcaatggttgtaataggtatgagagatggtattatcagtgctggtgatggggatcgttacataatcaattctgctcatatagattattttgttgacggtggtgttcgtggtggtcgtggaaaaccccaagaagaacctgttgatacaacaaaagaagagtggtatgttgtaatgactgatgacacctgtatttctggatttgaaagttatgaagaagctttgaaagaagcagcagagcataaaatggctaatcctacagaagaggttgaagtttataaacgtatggttgttgctaccatcggcgtatcttttgtttaaaaggggaatgttatgtttaaagttaatgctgtttactgtttcaaaagtaaagctgcctgtgaagctttctctatgatctctgatgaaaatttcaaaatggcagctttgattgaagggtcttgtttccgcgtcgaagatgttagtgaatcagggtccgtttgctcattgactttattggacagtggagatattattgaagctggaaagtatccgttcaggagttgggagatattgttagctcgcggagagcgtaacttttttatgtgcgtgtctgcgggggaagttgtgaaagaaactaaggatgtttctgtttacaattctgaatttataagttatagtgagtatcaacatctggaaggcattgttggtcacttgttatctctgattgatattgaatgtgacctgcctgaatcattgaaagaagaattgaaagcattagatctgttataatgtttcgcacaacgaaaggagaataagatgaatctgactgaacagttacgccgtattgcaaaagaagcttccttcaacttccctgttgaagaagtgatcgagacatgttttgctgaagcacgagcgggaaactcttcaagaaatttcacgccatctgattttggtttggataattctcctactcatccaggggaaatctacaatcaggtgaagtggatggatgaagcagtagcaattcttcgtgagcgtgggcttattgtttataaagaaatggatctgaacggggcatacgagtggatcactattgattggtccgaggtgaaatgatgaaaggtaacaagatgaaagttaatcaagtgccgagcgcatacactttgtggcttgcgcgagcattacaccagacgatcaaaaaccctaagaagccaatgaagagcgggaagaagtttatgtctaagggcaaaacaacctttggcttcactcgtatgtctgttaagatgaaaagactggggtataagccaaactacgctcgttacccttctgaatacaactggtttgactaaagaggagaacaaaacatgaaaacatctattcgcgtgaaacatgatccgaacagcagttacccatacgtgtatgttgaacgtcatgaaggggactattataccataaaacgtaaagtcccaactgatacagggtttaactttgatgttattgcgctggatgatcaaggtgttgataatctggtgaatgcattactcgcattgaaggaagtacgatatgaaaatcagactaaaggtaaagtggctttcgattcttgtgatcgtttagccgaagagattgccgaatggcgtgatactcactaaaataggagaaagattatggctacttttcaacaactgaaagatgtttcacgtttagtaagaaaaatccgagaagcagacgctgctgtgcgaaatgcgctaacgccagcagagcgtgaagatcttgaagaggaggttaaaacagccgagaatgcttttgctgtgtatctttcaacactgtacacagggggttaaatgtcagaagaacttaaagaattttatcaagcctatcataattggctgttagctggtgctccagataataatcctttctggcacgataaaggtttgtgcagttgcctctatctttggtctggtggctatgatgatctaaattatgaaatgcaaatgcaattccgcgaagcagggttgtctgaagaatacccgtttgatgacggagactggtttaaatatgattttgcacaaagaaacgggctattgcatttgaatgctgcccgtataaaatgggtaaaagatcatgctacacaggaggatgtgcaatgccaatagtgtttagtttcttaataattgttatggttgttcttttcgcggcatggctttggcattttgacccaggagcagcgcagcaaagagctacagactggaaagaacaatgtattgtgctcaaacatgaacgaaatgcggagaaatttcttgacctggagtgtgatcgccttgtaagatacaagcaagataaataaccttgaggtgcaaaatggtaattgagattaaacttgaatatgctggggctgttgctctgatcgcacaaacgttgggagcaaagattgaagaagtgtgtatcaatgcctggagtgtagagattgatgttcctatggataacattgctaatcgcttgctggtggcagagtgtgaacgcaccaacataatctacaaaggagcataatatgaaaattagagtttgtgatgtattgggttatgttggttttgagaatgttcagattccttttgttgttgaagcacatcttgttagtgatgatatgacaacattctttgttacgatagaagaaatgtccaaagttgagggatgggagtggtttgaagaagatgtttgggaaggttgtgattacgtatttttctctgacgaagtgaatgttcttgcggagtaagtatgtcttgttttacaaaagcagtgtccatatgtaagaaacagtatgaaagtgattacggaatatttaatattccagcagatcatacagagtattgttcatgtggtggcagaatgaagaaaacagtgatttatgcggataatggagatgaacttgttccagttatggtttgcaaagcttgtcattctgttaaaacattaaaagcgtaaggagtcgggacacccgacgattggagctaaaaattttgcgtacaaccctttccgcccaacaggggcgcgtcgggtaaataaagaggagagtttatatgaaaaagatcatcgtaggtttcttgttactcatcgcatcacttggaacagcaaatgcgtctcaagtttatgagtgtgtgtcagatgtggttgttaaaaatctgaaaggtgaagtgatttctggtcctaagaaaatggcttctgttgtcattaataaagataactcctttatccttaaaaattcaggcggtgctttgatgagtggcattctgcaatacacaggagaaaaaagtaaagatggtagtgctatgtacggttcacaacaatttattggcactactgaagtggttatgctacgcacagaatatcgggacactttagcttggtttgcatttcttaaaaatgataaaacaataacaaatgttcttactctagaagctgattgtactcaacactaagagagttcaccgtaagatgttcgaaatcatatttttcactgtgtgtatatttcttttaggtagcttagtttatgaataggagtttaaatgtctaaagttaaacattatggtgtaaattggagtgatgcttggcctctatgtaaagatgaccctacagaagggacatttgtaagatacgaggattataaagaattattagatgctgtgatcgcattgttagacgatattcgttcacgttatccaggacaagacttcacttgtcctcacattcaacttcttgcttgtctagtagaaggtttgccaaaggaggtagaagaagggtttaagcgtgtgcaatatcaaggtgaaactctagatgttcctgaatttgttaattatattacaacagattcaagtggtgatcgttatggttacagtcataagccagagattccagatttcgttcatgcttggcgtattccttatgaagtaatcaatgttgcagattgttggtatttaggagaaggagacagccgtaattggcgtgactctttgattcaggtttaacaatatgaaagaaacattgccagcagcatatcgtttgaatgatgaacgtatttgggagtggaccgacgtttcttgcttttaccccgaaatagttcagtattggcgagcaaaagggtgtgttgtagttatcaatccttgtggaccagtagatgaagattgcctgtatctcgatgggaagtggcacagttattgtcgctggccttttgagtggatgtgtaaagaagatctcccagaaggttgggagtatccgaaagcaaataggagataatatgtctaaagattttgttgaagtgtttgtcaaagacgaagaaactggtttaggcacaggtttcatttgcgaagaaacttttaagcgtgaacaagaaaaagctattcttatgcaccgctatgatcatgcattagaacaatggaaaaatgcagaacaaaaatgcaaaaacctttacgcagaaaatagaaaactacaagatcaaatggagttgttagctatcagtttacgatctctcattttggctgtagaagatggttttaaaaatccagatggttttcctgtgagcgatattgaacatgatttgtatcttgctcgtggtgcttacttttatgttaaacagaagtctgtagaaggagagaagtgatggaagaaaaactggaacgtattatcgagttagccatgtctattggctacgacgattgttttctccaaactattggagaaacacagaacgattacgactcttgggtgaaagagttggaagaactcaaaacttccttgattgctgactttgctgaagccgaggataaagcagatcgttacaactatctgtgtcgataagccttgacatttattttatgtatggtatacatacattatcaacgtgagcaaggtggtgtaatatgaataaagatcggtttctttctttagtcgcggaagctccttttgatgttcttggggtgagattatggaaagacagaaactatgggttagatgttcaaacatactctctttggttggttggggagcacagcttagatgaaagcttgtgcatgggtagagattctcgttccctctgtttaaagttcagaagcttagaacgcgcaaacaaagagcaagaaaaactaacgaggtggctaaatgaaaacaagcgcaaggttgatggagttttataaaatttatctagcatggattgatgttggtgctcctgatggtaaaccttttcggcgggattgtggtttgtgtgccaacttgttcgattatgtgcacagaggtaattacaaccccattataacaaccttgtcagatgaaatgcacgcacagttttaccataaagggttgaatcaagaactccctttcaatgagaactacgatgcatatgtcttagaatcagatgcagaggtatgtcacctgaacgtggacaggattaattgggtaagagatcgtattgcagaggaggaggatgaataatgtcggattataactggtatgaacttgaggctgtttgtcagttttacgactcaatagttctgcgtgatccaatctgtcaagaattaagtcgccgtgcaagtgcattggcaatcaatgttaaagtgcacgattggaacgcagatttggaaaaagaattggaattccttttggaaacaacccgtgtcttccataaagtgttccctgaatggtttgagatggagggataagcatgtggattgtccgtcttaagtatgatggcaagtttccgtgggagaaagatgtttgtgcctgtgattcagcagcacatgccaaagcagcgggtcaggcagtagttgacatgtataacaacaccccctttgatccagaaatggcaggtgttacaatgagcatgttcacttactattcttttgaggtttactatcatgaaggagagtggaaatgagcgaagaactattaacattttaccgcacgtatttggcatggttggaagctggtgctcctgaaggtgaaccgttcacccgttgcacaggtttgtgcacgaacctttatgatttttacgacataggagaaagcgaacgatacgaacctgtactggatgaaatgcatgagcagttctacctcaaaggtttggttatggtgttgcctttcaacagtaattttggaaagtacaccttagaagcggaaaaaagccgttgtcatttgaatgtggatcgtgtgaactgggtaaaagaacgtgtagcagaagaaataattggttgacagaaggatctgtctttgtcataatcatctcatcgaaacagagaggagaaaatcatgaaaaagtttatttgcacccgttccactaacagtgatatccttgtaggtaaggttatcaaaggagaactcttccatgcaaacggtaagaaatatattctgctgaaagattctttcaacggggaatatccgcgctgcactttcttcaattacaacactccgtttgctttagaaggagatgcttgggactgggctgaacttcatcctttctgtgaagatggacagacagaagagcaggaagaatctacgggaagtttacgtgataaactgcgtaataaagcactacaagcaaattcccattttactgaaatggtagacgccgttctattagagattgaagattgtgcggaacaagggaagtttgaaaaatactttgaaccttccagttttggtttgtgcaataacccttcttcttatgaacagataagtgaacagaaaagaggggcaaatgttgtagctacaatactacgtgcaaaaggtttggatgtaacattggcaaccgcagagcacagtatttttgggattatcaaacacatcattattagttggaactaaaggagagaatatgcaagttgaagacctgatccacattctgaataaagccaaagagaagggtgctatcaaagactggaaacgtgaaacaagtgaagatttatctcactgttgtcgagaattttacatcgaaggtattgctaacgatcattatactattgaatggtatattaacttaatgactcttaaacacggttcatttgaggtttggtttgatgacattgatgtaaatggttttcatcctggctataaaatcgctatgcagttatcttatcgtagagaagttgtagcacatttgggtttacataactaaggagaaaagaatgcaagcagttgttaacgaagctattatgaacttatctttcttgttagctggtttaggaggtgttctcataggtttggctcttatctggtgtattcgtcgattaatcgggtaccgacaaaaaggtgtttcatgttttgtatcttacaattttacaactgcttacagcaatgaggttggatctggcaatgctcaagcatttttaccaacatatcctcctacggtggaagatattagaaacttggaagtagaacttatgggactaggtgataactatacatctctagttattcaaaatatttttcgactaaaacagggggcgtgaatgaaggtacattaccctcatccatttgatcctaaaaacaaagccgtaattcttcgtcagtggcaacgggtttgtcgtactaaatgtccaatcaatagcccacacaatgtagacaaggactatcttgggacatttgttgaatacacttacatagacaaaaacaagcgtaaacaacatgtcgaggaatactgcttaagagtagaatggctgtaaataataaataccttgacaagtgtttattcgttttgtaaagtgagaatacagcaatggtttaggagtggttatgaaaaagtttgttgtttacagtcgtctttctaaacagaaaaaaggtgaggcacaatatggtatggagagccaagagaatgatatccgttacttcttagactctgtgcctgatgcggaagttattggtcaattttctgaatactattcgggtaagggcgattggaagcaacgtaaggaactggttaaagcggttgaaatgtgtaaagctaccggagcaactttattggtagctaaagttgaccgcttgggtcgtaacaacgcctccgtagcaactcttctagaaatgatcgatgttaagatagccatcatgccagacgcagataaaatggttatacagcttctgtctgttctggctgaacaagaagttagaggtattgctgatcgtattaaaaagggtcttgctgtagcaaaaagcaaaggtgttttattaggcagtgctaatcctaaaactgccgctgcacgtagaaaaggaaaaatggaatacaactctgttaaagcagacgcttttgcagagacattccgtgaacgtttggagatccttagagatttaaatacaccttacaaaactattgctgaaaaattcaatagtaagaaaatagcaacagcacgtggtggtaaatgggatgctaaaactgtttctcgtttgtgtgccagacttaacattaaataggagaggatatgaaacaagaaaatgaatctgtagatcacttaatcatgctgtcagccctttttgccggatgggacgtattttttgaaaatttgttcaattctgctacagatggttctgattttatgcgccaatttaaacgacgaactgttgaggactatattttctattcaggtcggattgaaaaaggttacgaagatatagatacaatacttacaattaaagttttagatgtgatgtttagtgttatagatgctattgatgaaagtcttccgattttagaagattgtaatacgaaagcttatgtttacaaaatagcccgtgcttatgtgtctgcaaacagttgtcttctttccacccaaattgcggtgaacaattttgccaacttgttcgatgaaggagaaactttttatgacaattgatttgaagtgtaagaggattcttttagatttctataataattggttagaacacctccgtctctttccacgagaaagtggttacgctgatgttggcttatgccgaggtctacgtatgtatataagtgatgaatttcgagccgatcattctttagcatattctgtttatggtatgcaattagccagttttgaaaatgctggtttagatacaactttcccgtttaacacagcaaaatcttttgagcaagagtgtaaggaaaaacgttgcatgtttaatgaaaaacgtgtacagtgggttaaggatcgagttaaacaactagaacaagatttggatttcttctatgatgaggcagaataatggatagacaaaccttaaaaacaatggcagatgccactaattccccgtactttgaaaaagtaagtaaattggtagctcaagccgcagaggaaggatattataacataaacatccacaacccaagtcttatactagaaatgccaagtgataagaagatacaagagagtatctgtgaaggtattgttagttactggcgcgagcgtgggtgtggtgcaaacatggctttagacagtgcaaacattgtaagatatataaatatttcttgggggtgattttatgattcaatgcactcatatccaaattacttggagagatgaactttaccatttaggacaatttactgtaggggaaacataccctgtcattaaacataatcctaacatcgcaaactttgacaggatggttcttgttgaggacgatctaggtcaaacttattctttagatctaaaatatccgttttcttacggctacgattggatcgttacttttgaagacgtggaggaaaataaaacaatgaacgaaaaaaattcttggtattatcgttgtgaactgccgccagtaggtgaaaaggttatctttgttcctgatttggaaagatattcttgggacagttcttattctgttcctaaagaaggcaccgaagttgaagttattgcacatcgcacaacttcgcatggtaacgatgtagcagttgttttctgggatgatgaaggcgctgcttgtgcagggggctttgttgcaggtaattttgaacccctgccagatcctttgaaggaggcaattttaggcgtagcttcttttggactctcttacacatctgcacaagagatcgtagaaggtattttaaacggtaccgttccaaacgaaatttttaaacagattaaataatagttgcaccccgttctgcggggtgttattgtatatgtaaaggaggcgctaatgtattacactgaagactacatactgtataacttttttaaaggctggttgaaatgggctgaacaagctcctgtcggagattgtgtttttccttgggattctcgtcaaggtttgtgtcgttgtttggaagattggcttataaccacaaactacaattcagagactaagaaatctacatcaaagagactaaaaatgttatttgaagaagatggtttagatccgatttatcctttcggtgctgaaagcttccacaatggtctttttcttggcactcaacattatgacaaagatcgcgtagattgggtaaaagaaaaggtagcacagtatgaatggggctaagacttatcatcgttggttagaaagttatattaagaaatgtgaacttggtgttccaggctatacttacgacacggacgagattcttgatgaaatggaagtttggtttaaagagcctcgtgaactattggaaaacattctaatggcttgggatggtacggcacaaagcattgaaggaggtagaaatgagtaagaaattgtttaatattcgtgagaatcgtgatggatcgttctctgtagtcaatgagtttaacgtttcggttgggacttttattactaaacgtcaagcagaacaagtaagagatactttaaacaagtaaatttttaagggggacttatgttaggtaagatcaaagcttttttcaaaagtattattgaaggaagtccaacagaaggtgcattaggaagatctctaacaggagaaccgcttgccataatttctatcagtcggtatggtggatattcaattaaacaaacacctttaggtatagaaggtagtatgctttcttggacaatatctcaagttggtgataacagacttgcagctatagcattgcttcgtggggagtatgactattgtttatcagcatcttgtaaaaagcacctcatagagcacattagagacagagtagaaagagaaggcggatacttcttcgaaactaagagaaacgaacaaggaactcttgacttcactaaggtttactgggacaatcatactcgtcaaactgttgaacaacttctggaggaaagatgttaaaagcttttgctgtatactctactgtaggattcttttattggattatagttattgtcggatgttggttaggttcttgtgttgtgatgggagaatggttaacatacaatgtattcgaatgggatgtagtttgtagatcattacttgttatatggactgctattgtttgttggataactgttagtctaacattagatctatattgattaatagatggtagatagatgatcatagtttatctaccttcacttacgtttcatacctcactatcgtgagtaacatgaaacattattatatagaaatctactactcgctatcgctcgtaaacatatgtttagggtaccatatttttttgaaaaagtcaatgctgattcacctatcaattatctgtttaagataagtcttacctatcaatctaactcttaactagtattgcacctatagtaagactattcctatagttattaaccctcttcttctgtagaatgtaattagatccttgacaaactcacaaagcttatgttacattgtgtctcacaagtgaataataccgaacaggaggaagaatgagttccaattttctatacaaagcaaaagattcacgagatggagagaaccattggtggttgatcacagaagatggtgttatcatcctaccgtgggacggagagacgaaagttcaaatactagagaaagtaaaaggtgttagttttaatgttagtcatgatataacaactttcaaagcttttgctatgaatcctagtcttgttgctgaatggtaatccaggagaagatatgactaaaatgtatgcagccgttgataagctggatgggtctgattctgtttttattttgaataaaatgggtgtcttagtttatgcccgaacttctcaaaacatagagcaccaagtggaagcagcacaaattttagagcaaataacccctccatacctatactcaaatgttgagcgttttaacgatgcacttggtttgacgttaatagcggaatggtaataatggcgaaaatgttgaaaattgataatgtcgtaacaatcactacgtctataccttgtcctcctatgccttgcccctattgtggtggtgcaggatatgttatggcggatgtaggtcaaatttacgagtgtaacccgtgcaaaaccacaggttatatccaagtagaatcagaggagaaacactatgagccaaaacgttaaagaaaaagaagtaatcacggtaatccgtcagatggaaggtgccgaaaacaatgcttttgttactaagattcttcttaatatctttgaagatgttattttaaacaatcctggtcataaagattatcagtatgatgttatgatgggtgctttgcttgagattaacaaaaacacttttgctgaatatgagcaacacatgcttttaccagaggaagatcaggattatttgttatctggtgctttaagtgcacaagaaaatttctaccacgttcttaatatggcttatgcagatgaacttgctgtctcccttgaagagcggattcaaatggttcgtgacgtaatgaatgaacaaatccaagaagttgaagatctggtagcagagcctttagcagaaattcgtgcagctattgaaaaacaaaaaggaactcaatcatgatgcaagtaggtgatgtggtttgtcttaaaggtgcaaacaaacaaatgacagtaatagaaagttatggtgaatcttgtaaagtaacttggtttgatgaaaacggggagttgcaacacgctatattcgatcaaaaagctttgaggaaggttgaagaaaaagaatgagccatccgtcaatatttttctgttttgtagatcttgaaaacgagtctttaatcgttgatagtgagggttacttcacttattgggaatccgagcacgaaactataagtgtagtgaaagaaattatgcaaaccaatccaaacctaccagcacataagtacggtattgcaaaagtgtttgttactaaaacagagtacacaaaagagcgaagcactttgtaccataatattgaagtgattcactatttcaaagatgttatttaggaggttatatggaagagaagatttgggatggtaaaaatcctttagaagttggacacgtagcacgtgtcaaaaaatctactacaggtcctggtttttctggtttgtatcatataccagaagaaggtcagcacgttacaattttggctcgtgacaaacaaaacggagcaacgcctgtgtggattgttcgttggtatgacaaagatcttaacatttgcttgtcacctattatggctcatttgctggaagccccttgctctgaagaagctctaatttttgtttcggcttttcagaaagccacaggtttaacattagatgcaaaagatgtgcaaaaagcatttgacattattcaggaagacaacgatactacatctaacgacgaactggttgaagttacaatcttatcttcagcagatatccgagagattgataattgtgattttccaatcacatttaaaatgtcgcagaaagacatacagtcatctggaagttgttttggtatacctcgttggttttttgattctatcaaaaattctaatacagaaggatcagactatgatcaagatgacatgctttggttcttaaaaaaccgagagattgttctctcaccacttaaataaggagaaataatggtttcatttatcgtaggtgtagttgtaggctatcttattaacaaatatcaagacgttatcacggcaaaagtaaaagacattttagactcatctaaataatctatcaaagctgcatcttcaataggtgcagccttttaaaaggagatatggcatgactaaacgcactgattttaaatgtatgcattgtgggaaatcttttggggatcatcaagctcgcacattcaactgtccacgtaaaggtcgcggaaattttaaaggttttaatcccgcacatgtttattctccagattacgataagccagaagaagaaaaatttgttatttaataaggaggtcatatggaactcgttcaagaattgtataatgctttaggagcaaaaggaaaagattggcccgaacatgcgcttattgctataagagactccgatggtgagattaagttttcaagcgtaagtaaagagcacatcgtagaaacaaaactgggtatttacatgcgtggaacttattgcttattcaacaccagaatggtagaagctcctgttattgaagatggaacaaaagattgccccacaatcgtaacaaaagctgaatatgagaagtttttctacgctaaggcttgacacagaaacaatactataggatagtgatcctatcgtagcaatagaacccgcttcggcgggttttttcatatctgtagcaataggaggtcgtgtgttaaataaaatcgaagaaggttgtatggcatttttggtagataacccgtttccctttatggttaaggtccatgtaggagagtatttaggttatgacgaatgggattgtagtatcaatagtgaaatgcaccactaccaaccaacaatacttaagacggatcaaatggcgcgtattacagtagaggatgaattgatcattgagttatacgagagagcactacacaagtaagctagaacccacctaaatcgaacagagacgctctaaaatagaaaaggcacccacttgggtgcctttgttttattcttcgttagattgcgtttcagacgcgttaaattcggtttcagtacaacttgctaggtaacttatattttgcatcactacaactacaggtgtttgaagtttatcttctagccccgcagccacttgagccaaggcattatcaatatttgatttcctaacgcccgttccatgtcctgttgccaagtaaagattaccttcccctttttgtgtagcattggcaaagtagtaaacgtaatgtgcaaggtagtaatcacggatttcttcagtcattttattctcctaataagaaaggggccgaagccccttgagtggtttatttgtttaagtggtcttcgaccattttaatgaaaccttcattgctgaaggctgttgcagctttttctcggtaaacaaaaactccacgatcttcatagagaagtgtttcttcgtaattaactccagggttaactacaaccatttttgtcccgatgttaagagcaggaaaaagctcccagttaaaattgataacttgattagagcaacccactacaatcaccatatcttgagccgtcaagccgtctaagatgtggtacatatcgttatacaatggggcagtctccccaaagaacactacattgggcttcacatacttgtaatcatccacatcgatagcagcatagccaacatctttgatgattctattgtctacgatcacttcaggcaggaagccgtgaacatgtagaacatcttcatgaacaacaccagcttgttccagaagatcatctacgtttgtcgtgatgttgataacacgatcacagccgtactcttgaaaccattccgcgatctggtaatgcgcagcgttaggagttacactatccatctctacgcgacgtttattgtagaagtcatgagttttacggtagaggttgtatccctctgcatctaatccgccaacagccccaggaacacactgttcttgttggtatccagcacggaagttgaaaatgtcacacacttcagaaaggtcgtattcatcccacaaagctttgccactttctgtgtcagtgcggaaagtacgaacaccgctatcggcgcttaagccagcgccgcttatcactattaatcgtcttggcattcttcctcctcataatcatcataatcttcgtcatccaaatcgtacacttcgtcttgagaataactcacttcaaagtaaatatcaaactccgcaaacaaacgtagaatattggacatgctgtaataattatcgtaggcagattcagcttcatagtaaacataaagcaaatggttagccttatcatcttccaaatatttcccgtctgcatatgcatagtctgcatatgctttacctgcatcttccacaagagaacgatcaagcagagtaggaaatggtttttctttttcttttagtttgctcaccaaccagtgtgcaatatcatgccaatctgcatcctctccgctgaaacagcttgcgacttcgccaaacttggcatctcctaagtctccgctaatagtgatcatggttgaactattgtaaccacaagtttcgcaatttgaacaactgttgtgcacatgaatttctacttgaaacatatttcctcccataaaagaaaagccccctgaaacaggaggctttgttcagatgctggcactataccagactttgtaggtatttgtcaagggcttcttgatcgccttggcaaacatagcaacggaagtcttgagccgaaggttgtttattttcatcccagtcccaataaacattacccttataacgtgaaccaggaaactcaaaagaggctgtatgtgtaatgtatcctgggccaccagtgaaatcacagaatgagaattgagggtatgctgcctttactgcctcaataaaccaagctttacgatctaaagcttcattgatgctatacgcatgtctctccatttcttcccacgttttccagacacttctttcatcaggagaaaagacaagccattctggaaggtagagagtgtcatagtaatcatcatattcgatctcggaggcgcacgaagctgactcctccagttttgagtaatcaaaagcagaatatacccaccaaccatcttccagtaaggctttgacagggacgaagcctttatcagcatattgatcgaattgtttgacacggtggcttgtgcagtcttcaaactcacattctaaacgatatgcaccttttcgacgagcctcaagaccgtgtgtactgaaaataacaacacttccttcaccatcattacgatctacttgataagcaaccagtggttttgaatttgacattatttctccttatctagaagattgttagacaaaaacacggcacgagcaaaaccacgtgcggttagggatctaagttgttttgtttttgcactagctccgcctaagcttttccaaccccagaagcagcctatatgatctactggtttcttcactggttgaacaaaaccattgccgtgccaaatacaagttttctttgtatacccatcacgggtaggcattttaggatgaaagcttccttcctcttcaaacaaatacccaccatattcataaggatcaaagtaaaaatcgggtttacgccataaggttgaaagtttacctactgggttctcaatcatccaaggaacattatatttgttacccaaagcttccactacacgaatattagctaaagcttcatccaattcctctgtgctgcgttcgtgtttgctaccactacctgctaacatagtgcaaggtggaaatccaaaaataatatcgggtttaggtatcccatgatcttcagggctgaatgtagaatctatccaggcattcacataggttatgtttgggtgctccatcctaacctcgtatttaccgtgatccccttcatcagcgtttacacaaaaacacttgtgacctgcttcggcataacgtaacaccatgatcccagatccgtcaaacatagacaaaactgttttactcattacccctccattcaagacaagccataactttacgccaatcactttctgtaagaaaaatctcgtttgctttcttccacaaatctaaatcgtgaagggttggaatacgatatgttagttcacagaatctatgctcttcttctgtaatataaccaaaatgcagagccacatcgtgaaaccaacaccaaccatgcatctctcgaacaacatggtcatgttgagacattattttatgccgtaaacctaaccaacaaggaacagatactttagtagtctttaatctgtgatcaacagtattagagtattcaataatagttgtcagtttcaatcgtgctttttctaaatcctcatgcgtcactttgaaataactttctgaaatatatccacacatattaataacctccttcaaaaggctttactacatgatgattagctttaaaacgttcaacatagtcgttttcgcccatgttttcatatagcttaataacaacataaaagttttcccaagcatattccctaaaccaaccactagtgatggatgtgcagactttagataaagccattataaaactttgcttaggggttggacctccgatctctccaccgaaaggaatttgtgaacgttccaaagccaaaacacacgcttcttcataaacacctaacaggcgcacatgttttggttgagcaaaaaacttttctttgctggtcataacttcacttccatctttcatataagatttatatgccggagcatccattaccgcgattgcttcatggatagaatcatgatcataaacatacggaacctcatcacctttaaaaaagtctttactttttacgtttaagttcggatgagagtaagtgtatgtttctttctcacgcaactcataaatactcttaagattttctgggatctttgcgcccagtgaccgcatgaaatgaatatctttcatagttttaaagaagtgaggactatcctttttaaaacgatgactcattttaagaaggtagagcacatctaaaggagcaacaacatgtccagcgtaagttcgacgaacatcatcagaatcttcacaataactaatcaaagcttctgtgctatctccttgagaagcaatatcgtattccaaatgtgcaccagctatcattttgacatggcctttgtttcctttacgttctacaagttcaacaaactcctcttgagagaacatttttgataattcttcccactcttgttctgtacacaggtaatctaaatctacacaagggcgatacaagtcttttcccatgtccatagcatgaatttgcaatgcacggctaccaattaacaccataatatttctcctctattggttgataggttaagtttatcaagcttccagattcctgtcaataaaaaacccgccgaagcgggttattatttactaacacattgaggaagaagagatccaaacacctcttgtggttaaaccattttcatccaactctacaccataatcttcacaaatgaaatcaatatagtgatctgcggctggcgttcctgtagggtaataagtttctccgttaccgtagtcacctatccaagcttgttcctgaaactgttcacaaagttcttcaatctccttacgaaactttctttgtgcttgttccatctctttaactttcttttttatcagcagttcgccttcagactccacaatctctccttaacagctactactgtgccaaacgccttgagaattaacgacgaaaccatcatcaccttcaccataacaagaagaggattgccaatcttcaaaacagattgcgtcattttctaaactaagaccaaaaccagcatgttcagcttcttttgtaagttcgtccactaaagccataatagcttgggctttttcagttaattcttcaacattacgataactcattagtatttctcctctggttggaaaacggaacgacaggcccacatagaagcttctttcaacttagtctttgctattgaaatttggtcaaggcgggtggatatattggtagactcttccaaatcttcacaatcatccagttcagtccacaattcagacattagagcatcaaagattaagcctaatcgaacttcagcatctttaatagcattcactttaccaattttgtcatcggtatgcggtttataacctttgatatcttcgattcccactttacctcctattaacaacttaaagaagatggatgccaatttgttccagtattctcattttcatcttctggatcataataaccacccatcccatattcaggggagaaactgaaaccttcaccagtctcgtctgctaactgctctgcttctgctaaagcctcataagctgcttttacggcttcttctactgttttaaacttggtcgtcataaaatttctcctctcctaaagacatgttgacatgaaatgcgcggtatgtaaattcgttgtccgttgtgtttgaataaaactcaaattgaacaacaccgtcttgagaagacaaatacatgccaatttgaactgttccttctggtaccaggtaagcatactctggacgtagggttacattgtaaaaataaagttccccaacacccatttcatcccaagcttcccaagcggtaacgaagttactttcaaaacttgttactgatccgaactctgccataaaacctcctcaatcttgtagtttgactccatctccaacacatttccacgaacgtctctccgaagaaaggcgtaagctttattaggtattgtagactcatatttaaccatatctggcacagcaaaagatactactactcctgctgggcttctgtcaagagccttattaatatttctaaggatatcgttagccaagatttctgccaattctccaagaacggtttcggttatatctttatatcccattaagtatttgttgatatctttcatctctgtattgttcagagtataatccaaaggatagaaattcaaagcggagtcacttttatgtgtccacatgaaatgcacccgatccgagcagaatcgtaaccctctttgaagaatatcttctacaacaggcagaatttcttttgtcacatcattaaccatgttgtaatctaagatttctgccaagtttgttctttgttcaccacgtttacgtttaggaatcacttgttattgccctcattaccaaaggtcgtagaaaatcgtaaatctcttgttttgttttcccacgaatgtttaaacaaggaacattattggctttagctatcttccaagccgtagctgttccaccttttgcatctccatgtttatcagtattagcacaagccaacaagaaacaggatggagcaggattttccaaatctctacctaacacttgatgcacattacgttggtgcaattttctagcaccctgcttaagcttttcataggctgggtgaacatctttgatccattgcacagagatagcatagttcattgtatctggttttgcaagaacaataacatcccctggaatctgattacctttgaaattttcccaaggaacataaatctccttgttagtaggattttcagactcttggacacctgtttcaaaagcagaatcactaccctctgccttcccagaccttaatttaaacccaaggtttgaaagccatttccctatgcctaccatcaaagcccactcttcttcggatatgtctctacttccaactcccgtatagaacagttctgccataatcacctcaacaagtaatttcaaaaggtgtatacggttccgtatttctcatgatccaaggactgctaggattgctcggatcataaggaccaaaaggttttatggtcggttgtgtttctttcttctgaatctcttcaaaaatacgacgaagttcagaatattcttgatccaccataagattcggtgcatctgattctacagcttgcaggttatcttccttaagaacaatctcacgaacaagattaacatcttctgtttctaagataacttctttacggatattacctacactttgaataattgtaatcttatacattaatcctcctcaagagttgaataaaattgaagaccaccgtccatatcgaaataagcaaatgttaagttattattgaacacagatccagtatccatataaacacgattcgcattgataataggtgtttttacataagagtgtccatgaaacacataatccacacccatcacaacaggaagtttcattccctctttagcacagtctaccatatctctgtcccacataagtgcttcagcaaaacggttttcctgtgtttttgtcatcttcgaaatgtattctggaatatctgttacagggagatattccaaagaagatggatacccaccatgaataaacgcaagtttcatgcctctgtagttaacaatgagaacaacaggtaaatcttctgtcatcattgctaaggctgtagctccttcttcaccacattcttcaaagaccgtatatcctccattttgataccaacactcgtagtagctacgatctccttccagcatacctttaatcatcatgtcttcatgattgccacgaatagcgtagcgattgtgtttacgagtaaattctaaaacacaacgaaagttttgctttccacggtcagtaagatctcctagagatacaaccacatctgtatctcggatacctaactttgcctttcctttttcatacaaattataacaaccgtgtagatctccaattataaaaagatcttgatcgcttttaacagtaatttctctgtgtatgatcacttatcctcctcaaaatctaagaaaataaaaatattcacctttccttcaatctcttgttctaaaacaagatcggcaaattctgcataagctttctcttcaactttttcaatatgttctgcggcatctttaaaaggcgtatccccatccacctttactaataagaaaagagatcgcatttcgacgtttttactgttacgaggaaggaaatctacagcttcaacaattctccaacccaaatagccaggggttttatgaatctcccctaaatacttttctaagattttacgaccctcgtcgataagggcttgttctgtagtaatttccattccttcctcctcaaattattaacgaaaccgcatgactaaatcttggttcagatataacctctgctacagtcacatatgtatcgtgcagccaaaaagattctactctacaaacacaaataccgttgataatgaaatctacacaggctttattattttcgcacacttgttgactataaacaacccctaaagagtcataaagtgatctcactgttgctaccatttcatctgtttcgtcttcctgtgaaacaaagaaaacgaatacagacaagttattagcgaaagtattgctattctctacttcaaccgacttacaaggtaaaaaggagtaatatttaccgttaggtatcaatttcgcctcaacctggttaagtatgctttgagatggttttgttacataaaaaagattttcagttgggttttcaacattactccttactatgcaacgagtggggttcgaaggatcaaaaacatgatcgaaatcgacacacacaggtaagttaacaactttaaactttttgctaagaatgcttactgctgtaaaaatcaaaccagcatttattttgccagtgaaagttgaacgcataactactcctcggatcattctaccaaagagaattccgcctcttccaggtagattacagaccttgttgcatgatatttaacgctccagaaattaccttcgcgccgtaaaagtatctcattcacatcaagattgcttagaaaaaccatataacttaaagcttgttgacgcgttgagaattgtttctctaaaagttcttctccgctctgcataatccctccttaaaatactccctccgaaaagggagtataagtatatcacgtagttgttatgttgtcttcttggatattagaatccacttctgcaaacatatcttctgcactgtaattatttccagtccagcgtgataaaaggatagcaccaatctcttttgcatgagattcggactccgcataaacgttagtcccagtgtcaccttttttcttttcatgtgcataaatgcagtaataattgtaagccattaatcttcccagtcattgccctcggtagagtgaactaaagctcgcacgataccaccgtaatctactgcctgatttgcagcatgttcggcataaacttcaatggcttttttgaagaaaagagcagtagctgcttcaatattatccatttcgccatctacgtcagtagaaagtgaaaggttgaggctttcatctacttcatcaaaatcaatagccactgtcataattagtttacccatagttcacactccttaaacaaaataaaatggttgagagaggcccaaactattctttgggtcgtatacataccaagcgtatgctgtcttatctgttccacctgcaacaaacgaaggccgttctgaaaggactataaggtttgttggtggattcttttgatggaactctcgtcgtttctttgactccaagaagcccaaccgaagaagataaatacaaacatccgcctcttttaagctcttttccaagaactccattgctaacttaaatggaggatttgtgattataatgtcgggacgattttcccattcatgactaaaataatctttaccttcttcaagttcacaatattctgaaccttcaggaaaatggcgataaatcgcttcagcttcacctttgcaaggttctgcaaaaacccaaccttcttcctttagatttttgaaatctataacactaaacaaactattgattgctttttgcggtgtcggataataatcgctcgttgggcgatcataatctaatgccatctaaaatctcctcttttgtaatattatccaactctttaaaggatgaaatctcgtttaataaccctatttgatcagcctctagaggataagtgtttttatctgtttttctagacagaatatcttcaacaaacttatcaatagctaaagaagaatcataaaattttaaaagttggtaatccataggagatattttgtcatctcttagaaatatttctaacatgttttcaggagtatcgtggtttagtttatgttcaccaaaaatattaacttcgtaaacatctttgccaaaccaacgtttcttcttttcaacagtataggtttttgccaccaaaccatctaaacagtttcttgccctcttacatgtttgacggtaagagtggatagcgccttcaacaaacttagcaggaacttgtaacattattaatctcctatgtttaagaaatgcccccgaaggggcagtttgttaaatagcggttccttcgaaatccgccacatttacgagattaatattttcagatttagaagtcaagttgttttctgcaacagatttttcttcagtatccgcctcgttacctgccacgttacgaggttcttcttcaccgtagggattaccgaatttcaaaagattgatcaattcttctttggagaagttttctaaatcatcgtctgttaattcaataatctcgtcttgttcttcaataaatgtttcaccaccagaaaaagcatctcgctttttagctacttccatagcttgttctggtgttgcccctgcgtcaagagcagctaaagcaaagtctgacccacttcctactgcataatattcttcatcaatcggatatgcacgtgttgggttgttaccttcgtgcaggaaaatacgtccgtctggatgaacaacaagtgcaataaactcttcatcttctttatctggatcagagtgaatcatcaaaccagggacagcatcacgtgctgcttcgcactgtagattttgttcaaaccattgaaagaaagaaagcacggaggtcagacgaccagcaccacctacaaggtaatctccaatttttcggacctttttgaaattaatagaatctacacgtccaccaaaagttaccttaccgtcactcaaaatcttatttttggttgcaataattgtcgtcactattcttcctcctctgttaatgttttaagaaccgctttcccgccattcacatatttgcagatgtattctatcgcacgtagtgtctctttgtcaacaaaaatttgatcagacgttgcgagcgggttattaagaagatcactacaatcacgaacaagcagtgctttcttattaaacaaattacttaagaacagtaacttcgcctcttcttctgttatgtgcagaaggctaggatcgtagccagctattcctattatacaatcaaacaagctttctttactatcagaaagttcttgaaaatggtttaaaagccaatcttctcctagacaccaacatttaaacatttccagtttatctcggagggtcatattctctaaagtaagagcaatctctttttcaatatggtttacacaaatttgacgaaattcgttaggttttacgagtcccgtttgatagcactcatctataccgcttcttccgatagctattgttgctacacccatcaatcctccttataaatggcttccctgccatgttattaaataaacacttcagtaatcagtttagacaaacgtccacgtttattatcgtccgttgtcagttcaacgtatccaataaaatctacaattggctcacgaacaccttcttcattttctggatataaaagttccaaaatttgatgcagaccattgctacgttttttaattgcatatgtctggcgaacatcgcctaatacaataacatgcgtattaatacctgcacgttcaataagaagtttaagtgtttctgttgacataagttgtgcttcgtcaataatgacgattgtattatccagggtggcccccaacaaatagttaggaatattcaattcgatcttacctgatccaatatcgttttccaatttgttggctgtcatgaattgctggaaaatacgttttgtagattcatagtgtgctgctagtttatctgttttatccccagacaagaaaccaatctggtcatctccgacttcagtagggttcttgataaaaagtagtttacggaagtctcctgaacgaagcatctgcaaagctttccataaagcaacagaggttttaccagtccctgccggagcatttacaacagtcagatcattccaaatcatgctttgaacaatcttattttggtccccttcaggcataaattcatctaaacggtaatcgtcattacctaccgcttttgctgcataacggctttcaatctttgctgaattagccagtttctgccgttgtgttttagctgcggttttatttcccatagtagcactccttttagaaggggccgaagcccctttattagttgtaagcatctaaagttccagaagtcagaactttaattactcgttcagcacggtttggcgtctggttataccatcggcttttacgcatgtttttacctgcttgagtataatatgcattgctgattaaagtcaagctattttgaaacccttcagcaccttttaaccccaactggaaaaccatgttgattattcccaatttacgagtatcactcaccttatcatagattggtgataagatagtactgttttttatgtctctcttcacttttgcaacatcgtcagcaaagatttgacgggcttctttttctgtgataactccattagtcttacgaccaagaagattatctaagatttgaatagcctttgctttatcttttattttagtcagaaggtgtcctatgccgactgtccaataaccaagatggtcttgataaacagtaagcttcagtccttcatcgactcgtagcatatcaaactcatctactactttagccatttacttcctattcgtcgtctcctactccgtgatccaactcgttaaacaacagatgttctggagaagtttcacgttttggtttcgttttctttatgttggacttcagctcatttgccaaagcacgagaaaagatcttacgtttctgtttacttttcataattgttactccgcaatttgagccatgagatcacgcagttcggtaaaaccgcctacgtatgttacctccccgttcacttcagacagaatttgtggaaatgtgcgtggaggaactccggtaagatcaacaactgttttagtcattgattctaaatcatagtcttggtcaagacttaaatattcaaactgtttattgcgcatagtcaatagttgttttgacatttcacaaaattgacagttaggtttaccaaaaattacaaattccattacctctccttattaagtaatactgctaaagactgttcaatacctttatttaaatctgattttgtaagatagtgactggttactagttgtgacttcaccggacgtgctgctggagcattataggttgaagctgataccgccgatatcttaacaggttctggcatctgtgtcaagatcttttccgcaaactccgcccaagaaataagatggcttcctgcaaaatggtaagtcttaacagaccttgaccaacctgtttttaatacttcaaaaatagcttctgctaaatctggagcatatgttggacaagagaactgatcagcaacaataataaaatcacgttgtccatcattatagcgagacaacatggtttttagaaagttatttccaaattcactatatacagacgctgttcgaataatatatgcgttcgggttaactcctcgcaccattttttcaccgagttctttcgtatacccataattgtttatcgggttaggtgtagtgtcttcaaaaagaggttgagaagaattaaaaatatagtctgtggaaatatgcacaaaatcaattttaagtttgctgcacactgccgcaatatttgcagggccataggcattaacagccaaagcagtagcaaagtcatgttctgctttatctacagccgtataagcagcgcaattaataacaccatctacataatcttcaataatagcgtttcgcacagcttcaaaatttgtaatatctacacgttctttaggataaattaaagacgcatttgaaggagccactttacgtaaagcttgtcccagttgtccattaccacccaataccagatatgttagcatacaccctcgctacgtagctgttgaaaagacttagccattgcatcttttgttgataagataggtttaaaatcttcgtcaaaaatcatatcgaagccccaatcaatccctatatcaggatcatcccaacgtaaactttgttcgctggaagggtcgtatggagttgtgcatttgtattcgaagatagcatccatactcaacactataaaaccatgtgccaaaccaggtggaagccagaactgtgtatggtgtcgtgcacgaagaacaacaccgtcccaagaaccgtaagtaggactatctttacgtaagtctacagcgaaatccaatacttcaccacttacacaacgaacaagcttaccttgcggattatttgtttgaaagtgcattcctcgcaaaacaccgaagtttgatttagacatgttatcttgaacgaaagtttgtctaccaatgatatcttcgtatttttgttcattatatgtttctaaaaagaaaccacggtcatctttataaacgtctggtttgataattaccgcaccttcaatttttgttttttctactttcattttccctccgctaatttgagtaggtattgcccgtactctgttttcttcagtgagtttccatggtagaccaaagtctctaaagaaatccacccttttttgaaagcaatttcttccaggcacgcaatcttcaatccttgacagttctcaatagtctgcacgaattgaccagcttccatcagactggcgtgtgttcctgtgtcaagccaagtaaatcctcgtccgagaacttctacttgtaacttcctgtcttcgaggtagctgcgattgatatcggtgatctccagttctccacgcgcggaaggggttacttctagtgcgcgttgaacaacagaattatcatagaaatacaaacctgtgacagcataatctgatttaggattttcaggtttctcttcaatagaaatagcttgacgattactcccaaattcaaccacgccgaatcgttcaggatctttcaccaaatacccgaagatacaagctccgccccaaacatctaccatctcactggcgttaatcagtagtttaccaaagctttgtccgaagaataggttgtcacctaaaataagagcaacagagtcttctccgataaaatctttaccaatgatgaaagcctccgcaagacctcgtggctcggattggattgcgtaagtgagttttatcccaaacatagacccatctccgagaagatacttaaagtcttcctgatcgcctggtgtggtgatgattaagatatctttaatgtcagccaacatcaataccgataaagggtagtagatcatgggtttgtcatacacagggagcaattgcttgctcacactgcgtgttaccggatgaaggcgggttccacttcctcccgccaaaataatacctttcataaccctccttaaatcttctcactccaccattgagggttgtttaagtaccattcaatcgttgagtagagatcttgttcaaatgtagagtttgcactccaacccagttcagactctattttagaaggattgatttcataacgcaagtcatgtcctttacgatcttcaacaaaagttatcaagttggaagaaggataggttcctgcttctggatgtacagcatccatgtagtcacaaaccatatagatgatctccatattggttttgggattacgtgttccaatattatacgtttgacctggttctccacctgttgccacttgaagaatagctcgcgcatgatcctcaacaaaaagccagtctcgcacctgatcgcctttaccatacaccggaatctctttattcgtcaagatacttgtgatgatttttgggatcagcttttctggatgttgataaggtccaaagttattggagcagttggttatcacaacaggtaaaccgtaggtacggtaccaagctttcacaagatggtcagatgctgccttagacgcactgtacgggcttgaaggggcataagctgtctcttcggtaaagggaacgccagagtctgccatatcgccgtacacttcgtctgtggagacatgtacgaacatcttaagtttattttttgggaggagccttgcagcttccaataaattgtatgtaccaataatattggagtcgatgaaaactcgtggattcttgatagaattatccacatgactctctgccgctaagtgaatgatgaaatcgggattgcactctactactaaacttttgacctgggtttcgtttgccaaatctgttatgcttagtttaacgtgagtgatatcgcctacattctcaatatctgctgcatagcccatcttatcaacgacaaaaacttcgttattgggatcttgacaaagagagcgcaccacggcactcccaataaaaccaagaccacctgttaccagatagcgcatcagttctccttaccagacatgttgagaaataatagtttccgttttaatgttatatttttcaagtagctttgcataggcttcttttgcattctcattcaattgctcaagatctacagctatgcttccttctccgccttctaaatcaaggccatatatgcaataagactcatccgcatcgtagaaaggagagatgcggcttaagtcaagaccttcttgtaagaaccagttaaaatctccgtcaaattcttcttcaattctaggatcttctcctacagcctcttcccacttattaaaaggtgcaccctgtaacatacgccattcgatatcaatacccatttttcatctcctcctcttcttgagcagctttaataattgcttcataaatatcgtaagcaatgcctccacaacatctagcttcgaaagctattgcttctgcaatgtgatctgttaattctcgtggaatgcgaacatactctttttcactctccatcttctacctccaacccttctttttcaaagactactactcgtccctcaccatgacaattcaggcaaggaaatgttaccataatttccacttccatctgtcccgtcccaccgcacacaggacaaaaaataagtttttcagccactattcctccttaattatttcaaatttggcaacaccatttacaataatatgaccacaagacataactcctagccaaggatcgccgtttttcttcaggcgtttaccgaatacatcacaaaaaccattcttcatttcagaggcttcataagaagcccctttatcaaaaacgtctttgaatgtgtcgattataccaacacatttcaaaatcattcgaagtcaagctcctcatcatcagagagatctttgttagctgaattcaatttgtaattagttaactgaatctcttgggctgctgactgaatcaaatcaggattcaaccatttttccatccaagctaaaggactatgtttaggtgctttaaacttggctttcattttcaatcgacgataaataggagcagcattgaaataaacccactgtttagacaattcggcgttaagacctacaataaaacgaccttcactaaacaggtagtcacaccactgttcctcttgttcaacaacagtgtcgaggatcaaagtcaactcttcaatattatcttcgtaaattttacgccaaattgggtcatgcatcaatgcatcaattacagcatagtccatcttaacatgcaagatttcatctagcataattttctggatcagtttacaagccccaacaaacagttgttgttctgccatagcaaaagtagcagagaaggaagatataaactgaataccttctaatccaatcagggctaccatccctttaagaatcagcaagcgaagttcatcgttagcttcaatcaatcctagagcatacttatgaccagcttcttccaactgacccatgatatcagcaatgatacccatacgattgaaaattttatcattaatcataatctgattgatgacttcaattggatctggagtacattgacggattatttcagaatacgttaacgcatggagaacttccatttcactctgcttcatcatcatagcacaggcttcattgttactcaagaatggagagaacaaagtgatgattgattttgcaagagaatcattttcccattggaacgataagtttttaatcataacatcatagttgtttttagaacaagctacgaaatctttacgtgtctgatccagattaacttcattctcatcccaatcttgtgctttttgaagtttgtagagtttatgcatttctggataagttacgttaacagaatcaaaaatccctaattgttcccctaaaaatactggatattttcctgttttgtaaacttcgttatgtaaattaattgctgccatttaaatcctccactatttcacaaaaaccttttaagtttaaaatatcatgttcctcaacaccattagtccggtagaaaccttctaatgcttgccatacgcttctaccgagtataacagtcactgtttcttcacttcttgcccttgttattgcgtaagccgtagcttctggataaaaagattcccaaatctggatattagctatttgaagtccgccgagataatggtgacaccaaacaagggtaaaatcttcagggggaatcaacaaaggcttaaacccaggacggtagattggggttactccaggtaaaactataagtgtgctcataatctctcctcaataaaaaaggggccgaagcccctgtattgttacatcttgcaagcttcacaaccaccatcagaatcttcttgtgctaaagaatctgctgattttgttctactattaaggtaatacaatgacttaccacccagtctagcaaagttcaaaataaatttcatctcttctttaactgataaacgtccccctaccaatttagaataatccaaccaagaatcacaagaaattccttggtctgtaaacttggtaaagataccatacatttctgcaaggtctttagccggagtatcccaggcggattggtagaacattttcagtttttcgtagtctggaacaataaataatacgctacctttctgactttgtttatacataatagtatcacgaacagggtacagagagttagtagtattgcttaccaaactgctggactcattaggtgcaatagcagccaagacactgttacggataccaccttgttcaatgatttcagcacgtaagccttcccaatccattttaagatcaaaattaccgatactatctactgttttagcataagtgtcaattggtagccaaccttgaggccatttggtcttatcgatccactccgcattacctttttccttagccagacgcagagaggcttttgccaaccaaaagtaatgacgttctgcaagttcatgcattaattttttagcataagcatctgaataatttacaaaattacttgccaagtaatgcgctaagtttgtaatgcctacgccaatagatctacgtgctttagcagttatttcgttatgtttaaatggataatccattgtttcaataacgttgtcaattgtcaatacagtgtagtatgcaacatcctcatattcttcaggcaagacacgaccagcaacaatagaagataagaaacataaagccaactcttgatcttctgtattctcaccagtaaagagatccggcatactatggaaagctttagttggtaagaagatctcttgacacaggtttgattgatacaccgtatccaggaaaggtgtatggttgttaacgttgtcagcaaagaacatgtaaatacgtcctgtttctgcacgttgaacaataatctctgtcagaagatcacgagccttaacaaattttttcttaatgcgacgacggcttactttgtcataaactgcatcaaactcttcttcacttttatacaaagcttcataaagttcaggagcatcatcacaactaactaacatccaatcttcgttttttgctgctcgacgcaagaacgaacggttaacaacaatagaataatccagtttgtctactcgtttatctataggtgttgttggattcttcagtcgaatcagatcgtcgaaatctggttcaagtatagtaaaggtaactgtagcactacctccacggcttgcttgcttcgaagctccaacactatcttccatccatttcagatacggaagaagaccaccatgaataatacgattattcttaacaccttgacctgtggcacgagtttgaagattaacaccaatacctgcgttattcaacgtatactcatgagctaagtaattagcaatagctaaagattctgccgtatcgtctgcacggaataaacaacaagacgcacttcctttgattggagttcgtagagttgtcagatatggtgatggcagattaatcttaagatcactaacataagtataaagttttttaatatcttctatacggcgttcttttggttggatctccataaccttcattgcaataccaatgaaaagaaactgtggcgactcatgtactacatcgttcaccgcatctcgaataagatatttatctaccatttggcgtaaaacagaataaccataagttaggtttttattatgttttacaatcttaccgatttctttgatctcttcatcagtataatccattttagcccaatgtccacgttctaccatatcatgataaaaggtattcagtgaagggatactgtggtatcccccatgagcctgtttgtaaatcatacccagaagaagccttcctgccatatcactgtaagcttgtgttttcttgtcaatacacgctgcaatcattgctttatgcagatcacgtgtagacacaccgtcataacaccgcttcacagcttctaattcaatttcagaccagtttagtttacctgctgcaaattcagaccacttgcgaagtttttctggattaaactcctctgtcttaccgttagatttagttacaaaacgaatcaacttctcctccctattattaatgcatattcaaaacatctacatcataaccgaacttcatttcattaaaaagtccattagcatatagaaaaccttcaaaatgagttatgtcatcaaacccttttgcttttgctcgacggtctgcttcttgtcttttaggagataaacgttttgaagtgtctagaattacagttacattacaaccaacagtttcatcaaaatagacttcgatttcacagccttcatatttattatcagtcattgtccctctcattgattagtatcatctgctttcgcaggatcataagagttaccgaaatcatccatcttaatatgtgacgcaccccaacctgtaaattcttcatcaccaaaatgaaaaatatcattttcttggtagattcgtttaaaaccacaattaggtgaaacagggaaagtgaaaagcgttgtatttgcaaacactactcgcttatcgttattgcttcggatattcacattacgctcaacagaatagtgtgaatcttcagccatacccagcattacaagcgacgctctaataacagcattttgtttctcgtgtgggatattgccattgtgtttatttgattctagtttccagataggggtagacattacagtagacatgcttacggtagcccaagttgtagtatttactaatgacatattttctccttcattttgaatgggaggactcacctcctcccagtattgtgctatattatactaaaactaatactaaagtcaataactatttaaacagatcaccatttagtatgatttgttaaaagttgacgatgttgaatccagcctttgaaattgccagaccaaaacttaccattacgatctacatgggtaatacctggttcccaagagttaaaatcccaaggagcattgataaacaaatcttcaaaacagttctctccgtattgttcgcatgtttcttgcattggggtggcttgatgttcaaacggagaagcatgaaccttgcgcccagttagcaaacgaccatagatatctaaagctttatctttagttgcattcaaacgacgatagctaacctgtgcacaacacgaagctgaaatagctttggcttcttccaaagtaaggacaacaacttctccagattcatcttgaacatagtatccaccaaaaacaaaatgatcgtcaccttctgtgccaatattatcatagaaatggtctacataaggtgtatgccattgccctggtttcagcacttctggtgtagattcttcatactctttgtgcatctctttagccaaagcctcgatagtaggatcggcttctttgtcatcacgtagccaccagaaattttcatattctgttgctgtcagaactgttttaattcgttggaaaggttccagaagacggtttgcaacttgtttgtggtaccctgccaaagagaattcttctgcaaaacgtgctgcactaagcgcggcaagatcccaccactcttgagcagtataacctgcatcaataagagcgtcatgatcaacacctttatcctgcataccaggttggttagccccaaaacgataaggacgagcaggttgatttcgcaccatttcaatcagtgttttaacaggtatagcacggctagaagcagcattacgactgaacaggcggtgagtcatcaattctgaatgaataatacgtggatattctagttcaaaagttacaatctcttttccgtcttcagtgatggaatgcgcaataatactagccgaaatctgttttgtcattttttctccttagtttttaaaattgttcaaagtgttaaaaacatccaaacatgttagccactgatcttctaaacctgtgatcacaacatttggttttttctttagttcttctagatggttatctttataaggcgtattaaaatatattttaaccacttcatctggaaaatatagtaggttatcagccctgtcatctattgctatatcacaaggcaataagtatttttctttcgtagcaaaaaagccgttaccagatcctttgctaaaatcaatcgtatctaacgttcttaaaacatgcttatgtttagaacttaagtgaccaccttttgtcacacttgcgatcaaaagattgctacctttccttgaaacatactttaagaaatctggcatacctggaacaaaacccattgtatcatagagatgaggattatccagaaatccgtaaggatctatattgaactcctccctgaaaccaggaaagtagttggtaagatcatagtctgcattttttgtgaatgtgtctatcttaacaccaagtccactaatcttattcaaccattctaaccaagcaacatctaatggagccacaactaaatcccaatcacatactatctgcataaaacctcctctctcttttagtatagttatcttatactaactttcaatttcctgcaataggattttgactatttgtttgcggcgtttcgctactgtgctttcaggttctattttacgcttcttcaaccaagctttatctttcttagctctacacaaagctattgcttctttttcagctttcgcttcttcaaaagatatgccttgcttgtctgcataagcaagaatagagttgcacaatttacaaaccattcgcaaatcttcttctttcacatagattaaacggaaaacaaaaagaggaatatcatcaaaacattgaagttgttttgctgcgtgaatatgatccacttggaagtctttcattcctcctctatgtccacatatttcgcactcacaattccaaacttgttttggttttccagttttcttgtctatcatcacattgccgtctttatctacgcgatcaactttaaaacgccttgcattgataaccttaattttattagggtgtctcatccatgcttttctaaaacatcctctaagataagtataaaattccgcttgtgttttccagggtgttccttcaccccacattatttttggttcacctgccaatattgctcacctttttagctgtatattcccctggtgggatattgtgtttaaaaaacaaaaggcggtctaaccccgccttgcacattgtttctggaatagtcaaagttagtaaaagtttatcaccttttcggttgaatattttataaacttctcctgctccatattgtttagtattgctcgccactaatacgttccttaagttgtttaatagcttcgattgcatctacataagaagagttatacatgtgtttcagtgctactcgtactaaaggatcttttgtgaagaaatcaataagaagcatagcttgatcatgtttagctgcatttgtcatagatggataattttcacgaaccatatacgtgttattttgcataagggttctttctagttcgatacaatgaatagctttatctaggttaatctgacgttcacctttaatacgtgttgcgtattttgccaatttgcaaaaacaaggtgtgccaccaaccaaataagctagttcaataggttgcattgccatttttgtgtagtgatcaccgtcaacctgattatcaaaagcattagacataattttcctcctgaattcctactgcgccttcttctgggtaatctgtataataagctaccctaccttgatagataacatcaccatcatcattgtagattgctgtatcttcttgaattgttattttaacgtcaagtaaatctgggtctttttcgatggtatagtttaaacctaacatttcaaacagttcgaaaatttcgttacctgttaatgtaatgctcatatttcctccttttattgtggttagcagagtatacactaatatcaaatttttgtcaataaaaaagggagcaataagctccctgattattagattccaataatagttgctgctcgtttatctttggatctggtgtttgctctactacgtgacaaacctccacaagattcacaacgaatgatatcgaaagaacttaccgcagtgtggtattgcttaccagtaacaacgtgaacatgatcactgccgcaacgagaacaacggactttctcatctgggtaataagcggataagttaggatgctgtggaatccacggaaggattttcatatacaaatcacggagtgaaacaacatcgccatcattgtaaatctgcatacgttcaaaagcatcacgatcaccttcacaacatgctttccataaagggaacccctcgttatccagtttttcactttctgtttcaaaatacgctcccatttctttaagagagttggaaggaagtgcaaattgtttcttagctgccttcaatgtatcaacaactacataattagaaggaggagccatatcgtgatatgcaaatcgttggttaatatatgcacggtcaaacttatacccgttgtgtgccacaactacatctgcctcattcagaaggttccaaagatcttggcaaagctcccaatcatctgtatgatcaatatcaaaaagaggataagaagacaagttcttaccttccacttcaccagtatacaagtcagcagaagagtaggatagcaaataacctctgcgaattacctggtctggagaaatgaaggctttgaatcgacggaaagtatatgcaatctctggtgcagtttcaacatcaataattttaataactggttgtttctttttaacgggttcttgtttacttccactgaaacgtgcaaggaaatcatttactgtgctttttcttgttgggctacctaaaacaattgctgcaatattacgagaagacataccctctgcactcatactaaggatatctgctttctgctcttctgttaatctgctcactctgcctcctgttgtgagatgtatgactgaagcatactctcaaatgttgtatcgtcattatcccagcgtttcatgtataccaactggaaaattgtttctatccattcatctgttgtcatatggacttcttctccatcccaagaagtaaaattaacaccatctgggaaccatgagtagtaagtatctttaactgtttggaaaagttctgcttgagttttacaagcagaaagaagattaaaacaagtaatatctccgaacttaatatcaaaatcttgataaggtcggatactatctgttttatctcccattagcatctgatatgctaaccagtaactgccccaacctttaacttctttctttttacctttatctacgatccatatgtcgccaatagactcgtcaataagaattatatctggattcttaaatactccatcctctttgtagaaattaaaaaggatactaggagtatgtaaactatctttatctatagacactacaatataagaaaatttacccgtccttttataatctttataaccttggaaaccatacttctctaactcatcgtcagcctctattacagtaacaacatcaccattgtggaactccacaagataatctttggtttctgaaagctgaagtggtttgatatctaatcgttcagacttatattctacaggcattttgaaggcgtgtctgaaagtttttcctacgccaataactccgcaatatttttctaaacgtagatgttttagaatacctaagacttttgttttagctgcttggaaggtgtgtccgatatcttctggcgggtattgcttatcaataatttcgaactcttcctttgtgaagggacgtttgtttttggaggctctttctgcatttgtatctcctagccaacctccaattttagtcttacttttaccccaaaactctgtcttatttttaaattccttttgagcacctgaagggatgtgcttcgcaatgattgttcttttctctaatgcagacgctgcctggaaagcgatctgatcataatcaattgcagctattgtctcttcgttgacatataaatgaagatcttcaggtttaattaaaatataaccgctaatatttccccctaattattcatcgtcatcctctgttgagaatgttttagtatacggacattgacgacttttcgggattgctataacttcatcttggttagcgttagaatagtagcaatattttgtgttgccattaacttcagaatcagacaagattaaagtaatttgacctgctgctactgtgaaactaaaagctaaaagaacgactgtcagaatctttttcataacgcctcctaaaaagcctacctcattaagtaggtaggcataatatcataactaatcccgcaagtcaagaacttatttaaggattgttgctttggttaaatcttccatcagacctcgaatctcattgaagcacagaaggactgaagcttcaatactaccttcttcgtctgcaaaatatttcggaaaacgtagtttagaaagtttaaactctttatccactacaaaatctacaacaccgtcatattcaagaccgattgcaacaacatctttaccatcttcttttagttctacagctttagactcgtatagagattctttactccaaacaacaacgccctcgctatcctccattttgatataatttccgagagtaatacgatctgcttcgtgattctccagcaattcaccaaaaccttttacaatagcttcttcgtgcacactaaaacctaccgaagggaaagtccccaggacggaacggaggaaagaagtaatctcttctgcaacctttttacttccattaagaacataaagaagattcgtagttttatccaagacaacatagttaaagaaatcttcaggttctgtttcaggcaatagtgcaaattcaatatcttctttcattgctttgactacttctttatcgacataaaactctttaccttcgctctccatgtcctgacgcatttcttctagacgttcattcagaatacgtttaactttctttttatctaccttcttcacagattgacctacattaagcagttcaagatctgaaaactcttttacaaatttagagtcatcttcgaaacgaacaagaccgatagtgtgtgactgggagccttctgctgttacgaattccagaggaatatctgtaatgctgttaagggatgctacagaagcattgtcaccaacaaccataggcagagcggatttaaaagattttacaaacatgtttcctcctatttaatacatctcacattaccgcccataaagggcggcttacaacattacttattaataatacctgcaatattaggtttgacaaaggtcgatggtttcatgatcttacctttatcatcaaagaacacatacactttctgtttttcattataaacagcatgaacaccagtgtatgccccttctggacgattggcatttcgttcttcaattgcagcgcattcttgtgcaatggctgaatcgatatccgaagttttccaagttttcagcaactgttgtttagttggatacttggaatcattacttttcaatacctctttaataactttcttttctgggtattttgaacggattagagtgtcacgagacatacgcataataccagcagccattagtgccatttgaactggctctgtaaatgtttgttccaaagcatcaaaatcagtatacacagttggagtaaaaacatcgcctacagcatagtccaagaaattcatcgtatgttcttcaccaaagaacatgtaggtcagataactggatactacaaaaatatccgctgctgcatccaagagttctacatgatcgtttactttcgcggctgtttcatactctttaagctcttcacgaacgaatccgatttgggacataaatagctcttgagtgaattcaggttgttcaccacctcgtgctttagcattccaatcaatcacgtgcttcgctgcatttttgaaaaattcagtatcgaacttaatatctttaaaaaaattctcgatcattataactccttatttaaaatagctttctagaaagttgctaatatttactacagtctcacccatgtaaattcctgcgaaaccgaaaacaagcatacgtggaatattgaaataccatttatccgctggaaaagatgccagaattacaatagcaattgctatcagcatcataagaattgttgctaaaattatcataaaaatgcctccaggtattttacacaatgataagctaagaacatttttccaccttattctgctggttcccaagtgcctgggatcatttctcgaatacgaacaccaacaggttttgttggaataccttcatctgaaaattcttcatactctatttcaacgaactgattaatcaaggtagaagcattctctgctttacgataattggtagtctcatgagcatctttacgcattaagaattcgactactttactattttccatctcacctgtcaacactccatcaccatttttatcactttttgaatttattactttaacttcaagcgtatgacgaggcttacgtttaataacatcataagaacgtttatcaaattcgtaaactccgtgagcattacgatatactacaccttcagctttctcaagtaaagctttttcatagaaagcatcaaactgttcttggttttcaatatactctgtatgaactacacaaataagctcatcaagaccataatcctccactactgccttaagagcagtaagaacatcaacacgtttttcaaacggtagatctggaactggaatatcgtatacgtaatagttcagcaaaggtgtatttgcattatgcttcttccaggcactgttaatttgttgtagactaaggacacctaacccagcaaacacttcaccatcaagaggatgaccaacaacttcactaataaagtttggaatacctttccaatgaggtggcaggttgtacacttccccagcttttgataaacactctcctttcatgttaatcatagaacgtaacccgttcagtttgtattgtgcataaccagggaacacaaccctttcaggataatctttataatcctggcatttcattggtgtggaaggaacatggttttcagcttcttcttttgttttataatagccattctttaactgttttgtccatttggcaaaagcttcaagttcagcttgttcttccggtgttgtttcattggaacgaccaatgttttttgcttctgctgtataagatttttctgtgatttttccacctacccttccatgagctacagtaacaactgcaccatctgtatacactgtccactgtttaagttttccttttgaatctttaccatacagcgtttgatttgtttgttgcattagtcctcccatttaaaaactgaaattttcaatctgttacacacttcatccaaatctgcgtcgagtaacgttgtagatgttgccaacatataatcaatgcttgtgaaaccttgccctttggcatagtcaagcatatcttcatacatatcttcaagatcaccgtcatcaaaagtagctagaaaatcctcgtccccgctacgaacataaaatgcagtactcattcatcttcatcccaagattcaaaagcacaacaatcatcggtttctataataccaacacgtccacaggtattgcaagtgattttatcaccgtagaataaataatttttatcaccttctgtgtttacagttatgtcattactaccacaaggacaagtcagccaatcaacaacgatatcttttttcataattcctccttaagcattcagttcgctgttgagttcatatatctcttcttgaagagaatcgatctcttcctccaaacgggagatctcttcttttagatataccatttcggattctttctcttctaactcattttcaaattttactttattcgcctcattttcataatgcagttcagcgtaatcatcacgcatttgttcaataagatgaatcagagataagatatagttatccccagtttcatcacgccactcttcaccgtgacggagaacggtaattcgtccagtatcttcgtctaaaattgtctcatatttacgatcatctgtataaatttgcattatctctccttattgaagtttaagtgaaccacgaagacgtttctcttgttgatcacgaatatgttgtggaacctcgtgaattgaatcgttaccgtgcctattttcaacaactaaagagataacttgataaccaaactcttcagcaagagttaaataaggtttaagttctttctctgtggttgaagtgttagaaacaataatctttttaagatcagatttcatagcatcacgaacaatactctgacaccacgcgtgtgctttacctacgttttctggcttccaatcgtaaacaccactttctgtgtaatgatattgatctgcctcacagataggccaataaccttcagaaataatttctgctaccgtagatttaccagcacctgaaacgccacgtaaaatgataagttgtttcatttatcctccaatgaagttttcgattttttcacgtcgctcttgctgatttaaagcagcccattgagtcttcgtaaaattatttcgaatccattctaacaaagcgtaatattcttcgtcaacaatttgtttggcattttttggattatcccaaatcagatcccactttttatctccaccacgcataagaaacttcttagtaagatagtgtggtgatttaatttttaaaagtaagttgaacggatagtttgtttcacgaactacaaacccttcgtgtttacaatgtttagacatttcaacaacatctgaaaacttaaccatcgaatgaacttcaggacgcttaaatttggtgacagaagcaattccatcaagagcaccttcaggtaacataaaacttgtcccatcaggattttgaattctggcaccaattaagtatgcacctggttcttcttcaacaatatgcggatcagaaggatcgcagatttcaaaaaggaaagttgcttttgcactctctgtccatttgatgaaatgttctatgtcatcacactctgaaacaatatgattctttgcaatacttgcaaaatctgattcaaggcttcctgttgtcgatacaataagttgacctttatatacacctacagaggccataaaaccatttactttacgaaccacatctacaagttcatccgctggtagatctgtgccattctcaaaacgattaaaaatcttagtgaaaggccaaataacaacattgtcatcagcatcaacaacgattccgcgacattctagaagacgagaatcaatgctccataagttatcccagaaaactttgttcttatacttaagaacagatagaccagaatactctccttctttatatgttttcttatgaactaaacctttttcaaccaaatcgtcgcaattaaatttagtcacattactctcctttgattattttgtgatggtctacagtcacgatatctcgtttactcatcatagaaattatctcatcaaaatgcaagatttttccgtgtgcatcccaacccacatctaacattttaccataagcttcatcagggaaagatccgtgggaatgcccgtgtagcatgattgatccacgaccttgtttattccaggaggccatagggtaatggcttaagacgaagaacagcttctgatatttcacttcgtcataatacaccacttcgccatactctgcaagcacttctcggtgtttactgtagtcatggttcccaacacagtaggtgatatctccttggagacgggaagcaattttacgggtatcttcttcagttccaaaacagaagtcgcccaaatgccacatcttaacaccaggggtagtagcgcatttgttccatgcttcgatcaaggcttctgtcatgtggtccatatcttcccacggacgatattcaggagcaaactctcgaatacgtttatgcataaaatgcaaatcacttgtaataaacattagtataatccctcgctaaataggtcacgatcatgaccattacgttcgtagtcaatctggtctgcgtgttttgcaataatgtatgcatcttcacgactccaccaattgtagtattgatcaataaaaccttgattgtttggaagacaatgcactttatcaagaacacctgcttctttcaatacattcaattgtgcagataatacaggatttgcatgtcgaacacaaggaataattaactcttcaccattattcaaaatatatttattcgcagcacagacgataacacgttgcgcataatgaccctcaccaatccaggtaagaggttggtaacaaatattgttttcaataccactcattgtttcctaatcctcctctcttaagttatcctcgataaaactagtatctggaagtaaaagatcattccttgtgtcgggccaatcctcttcttctcggtagataaagtaaccttcgtcctcttcttgttccgaccaaaccgaatgatgcatgttctctccttaatagtgcacacgaatcattttaataccataacgaagcattgattcttttgcaagcatgaatttatccccagcggcgggattagaagtatgcacgaaaatggtaggtgaaccaaagcaaggtttaccaaacgccagaagttcttccaggtacaggaaaacatcatatccatcttggtctgactccatacctaaatcattgtcaaaagaccactcggttactcttcgatacagtttagcaggatcattgagaaaagccatagcttcttgtgacgttttaaaccaaattgcatcttcctgtccatagtcggctgggttccgcatatcatctatccaaactttcatataacctcctctaagctggcatgattaaaaaagaactctccacttcaaaatgccaatcatctacaagccctgattcccaatccttctcttcatggaaagagcaaatccaacggtacatacctggcggtgtattctcaacatcttctggcaacccataatccaaagctgtcttaccgttctctgtaaaaccaggatggagattaggagctttcagtacagaaaccatgcctccaacatccacagctacgatccactctgtcatgtatgggctgtcatattgaggctcatcataacctacctcaacagcctctgtgcgtaagatgataataggctgctctgtgattggggctttgacaatatacccgtggtcctcaaaaagatcgataacctcgaactcatcgccgttttcgataccatagctcttattcaaagagataaacttcgggttatcatcgtaagctttagttactttaattttcatttttcctccttcactttaacctcaaattctacaggcttaccctcaatgtaaaaacactgatactctgccttatcatcctcatcacgaggccaagttaccaaagagttatagcaatcttctggtgctttgaagatggttttagtctccacagtaacactcccattaagtgttgccaataccacccagctacagggatcatagtgcctccactttccacgttttaccattatcaaccaaggtctttgctacagcatactccttcccattaacaaggaaataataaacgataaaagatttcccgattgttactgtcttagtaacctctacgcgtttaacaccttgcatgtatttcgccttaccggaataaagtaaaatcattttgcattcctcttattgttgataacatccatagcagtatatggtttattagtgccatgatactccagaatcattggagagccttcttgcactacttcaaaaataccataaacagaactttcagcaaataccatttgcttcgtgccttcatcgtttacaacgagagaaaacttcttgcctgtcccgttgaggatctcgtatttcttgccagcagtgaataatccagagtaccactcattatctgttgcttttacacacttcaggaaagtcttgatcatttctttttgctcctctttttagatttctcatacaaacctaacacagccgcttcttttgcacaagtaggaactgaagtcattcctcttcgttttgcttctggtagttgcaaagtccatattccccaccaataaatttggtctgccgtgagtggttcagccattggatctgcctcctgctcctcaagacgttgcaacgcttcttcaatcttctcgattggtgtgtcaaagacgaatgcctccgtatcaaatttatctttcttaggaactgatttggctactttgagaacctcgtttttcggtttcttagtaacgttctttggctttgataacttcttcggtgttttcgccacttactacctccatacgatctaaaaagtcattcacaaatctccagtaacgttgacctgttctaagatcttcatagataaccacaggatcaaacactttagatattccggcaggttttggaaattccactactgtatataaaccaccttttgctacacaagaataggttacgcctgtaattggatagttgctcatttctttacgtactccatgattggggtatggtcgccagtaagcgtaacacggctgtaggacacatcttgtgtcttcagtgtatcaatccactctaagaagtgttctttcgcttctgtgtagttctgtgtgcctttaacaacgtgtataccatctagagttacacggaataccatttgaataacgtctttcatttcttacctcctttgttgtcaaaataacttaccagaacatcgtgaaccacacacatggcaaaaatcagaacaattgttgtcaggactggattttcactaattagtgctatcatctttaaccacctccaattgcctttcgagtttgactttgtttgagaactgataatgacacaacttacattgcatgtcaacaatctgatcgtgatttaaccctacaattttaacttcctttgcaccatcccattccaaatactcaaagccatccaaatgattactcttgtacaacaagaatgctatctgctgccattcaatctgaatgtcatttaaatgatatgctgcacagaagatatcctcgtagtaaaagacgatcattgtcattgcttcgtccagcacaactacctcttgtcttgtaaatctcattctagcctcctaaacgcgtctctgacgcactttttatatataagatgataaatcaccttacttagtaagtaaacttgctctacgagcctcttatgaagcttatgtcatagattatactattgctacctgtttaagcaaggtttttgcacacagaaaataatttttaataaaactcttgacttttgttttcgaagtatgctaccctagaaatctattaacgagcgcagcgagttaaggtttttaggttgttgatgtagtactctgtactcaagtactgtactccgtactagattaataataaataattattagatctaacaaacaggtacagtgtatcagaactggtacgtacagatcaacttctatcaattaaaaaataaaataataaattattataaataatacttgatctatagattagtatgaagtacagtacggaacatcttaacaagaatggaggtgtgcaatgattagtgagaatccgtgcaaatggcatcatgtgcctattaaagattgtatgtcttgtaatccacgttctatttataacattgcatcttatgatgatgacaatgtgttagacgatgatgaaggctgggaggatttagattggactggttatgaaaccaaaaaggataaaattattcctagttgacttaagatatccttcgtgctaaactagaagtgaggagatgccgatcactccccatttggggttcgaaggatatatgcaaaatagtttttattttaggtgccgtgcttgtaataggcatttgacaaaccactccagacgtgataaaaatggagtcatcaaggaatcagacctctgttctatttgcacaggtttggcttttgatgatagtcccgaaagggtttatcagcatcaatgtataacagacgttctcgtgtcaaacttggtagaggacgaacaactaacagattaggaggaacaatgtctctattagaaaaacacgtgtttgaagatggtaacggcaatgcagtttttcttttccatccagaaaaatacacatctgaaaacaatggtacaacttctattgtaatcactaaagatgttaaagttattgatttcttggctctgatgcgagaaatggatcttgaaattaatacttttaacgcagaagctttggttgttgctcttctggaaaagaaagatagtgaagaagtagcagaatatgcttaaataactattgacaaacgtatccttcgtatgttaggatacgttcatcaagtgtggtaagagggtcgttgacttttgttaagatgggcttgcactgcggtagtgttagagactacttcttcagaggttagctaccaaagaggaaaaggaatagtctcggctcaagaacttttacgctgaaagttgggcttggtcttagagaatgtagcggttctctacaatcgtcagcgtctctgttaccacatttatggccctgtagctcaatgggagagctgtcggctcataaccgataggtagctggatcgaaaccagccagggccaccaacgtctttatggtgtaatggatagcacaggagtcttctaaactcttagtcaaggttcgattccttgtaaagacaccagaacattttaacatgaattagctcaagtgatttgaacccactactgatcatggtggcagagaatgaggcaagtatgtcagacattataaacaaaggccacggttatattagaagacataaatgctcgaagagcaccgttcgtggagaacgggggttggtggagtcaccattcatggtaaaatgttttaaaaaactattgacaacaagtattattttatgttagattataagtatggaagggcaaatcgacgtggcgacgaaaacggtcttgaaaaccgccgagctttaaagagccttgggagttcgactctccctccttccgccaggttaggtagattggtgaaatggtagccacgacagtttgctaaactgtagtcggaaacggcgtgtaggttcgagtcctacatctaccgccaagttctttttaatgtagcttactttagcagagtaaatcttcggcaagtggcggtaaccactttaccgataactcatagttagtggtgcgaacactggctattttaaaaagaatttaaatactagcatttaggtgagttaattccgtaggggtagcggggcagactgtaaatctgttatcattgcgattcgggtggttcgactccatcactcaccaccaaattaagatgagttggctgaatggtttaagcggcggactgttaatccgtgttcgaaagaacgatataggttcgaatcctatactcatcgccagaattatggacttgtagagttaaggtaaacccccagtcgccaagaggcttctggaattgcaggtatcgaatcctgccgagtcccagctttgctcctatagtataatggctattacaacggttttgtaatccgtggatctctgttcgattcagtgtgggagcaccaacacaacattaagagcactgtgattgatcgtcgtatcctgtgcacaaggtctgctcgaaagacagtgttcttagtattgtgttgatcacaaaaagagttacccgaaacttgaccggagtagggttggatgggcaaaagaagaagcggctctcccatcgacagcaacgaagaataatatttgactttggttttgtattattttaagttagcttaccgaacgtagggctagtcacccaaagggatactcgtcactgtcccacctattaaataactattgacattcgatagtaaaatgtagtatagtaaatatatacgaagcgttattagtgttagcggttcagcatcccgtccttccaagtcagtggcatcggttcgaatccgatataacgctccaaattatttaataaagggttgccagaaaactttctcttttactcatggttttctccttctctcacacctcttctggttgcccttcattaaatgatttattggtttgtagtgtagtccggtagcacacgacactttgactgtcgtaggtttggttcaaatccagacagaccagccatataacggaatttagctcagtttggtagagtgtacgctttgggagcgtattgtcgcaggttcgaatcctgcaattccgaccaattaaatatttcatgcgtcagacaaaaggttagtctgtatcagacgtgagatattcttttaaatgtttcgtagttcaatggtagaacccacgactgataatcgtgagacacaagttcgattcttgtcgaaacaaccagtttcccgttagacttacaggataagagttccacagcttattgtgatgctggttcgaatccagcacgggatacataatagcgggatagaggagtctggtcgtcctcgccagtttcatatgctggagatcattggttcaaatccaattcccgcctccaaatatcgcttgccagcggtatctttgaagaccttgcctggttccttctaagatggaggggtgcgactccttaacgcacaattataataaagcatttcaaattaacagtatttattagcctccttattggaggctttttgctatctattgaataaaacttgacttattattttttatatgttaagataaagtttaggaggattttatt

SEQ ID NO: 31 - DNA, 153880 bp, synthetic construct
  source 1..153880: mol_type = other DNA
atgcctaaactaaaacgtggtcgtggaagaccaacagccgaaatgcaacagatttacgcaatggatgcggcgcaagcaagtgtaaaagaattatttgcagagcattatttagaagctatgcggtatattgttgaacttgttaatgataaggatgcagcaaaacctctccgcttccaagcagctaaagctattaaagagcaagtagaagaatggttagaagaacattatgaagctatggaagaagaaactcctgccgtgcagaatacagatgacgttcctaaaaagatcgtaatctaatccctctcctctcttggggctttgcccctcctccttgttatttttaacacccctctccgaaaggttaggggcttttttatttttaatgcttgcaattgtatatcattttatgataagatcagatatgaggaggataaaatatgcgcaattttgtagttaaaaatgattttaaccgttcttcttatcataaagataaaaagaatgattacacacgggcttggaacttggaggaagaactttatgatgacagagaagacttgggaagagatcctagcggaggctcaaccaatggaagtgaagaagatagttaacaacgccccttctcttcctaaaataaaattttatgaggaagtagaagataatgaatctaaagactaaaactgtattaagttttgttttaattgttgttcttattcttgccggaatgtttgcttataacaagatacgtgagtctggctacaaagatggtgttgcctatcaaacgcaagtatatcaagcagcccaagcaaaagcaaaacaagattttgatgttcttcaaaaaagagcagatgaagaaagagcattattaaatactcaaataagcaacttgtctaaaaacaatgcacaattaaaagcagatttagagaagaagaaacaaacgatcaatgaggatacaacgaattatgcaaaaactaattctggcagtatgtcttgctttgcccctaatgatgacgggttgttcatcatcaacaaaagtttccccagttcttattgatgagtgtaaggctgtagccatagaaaaggttaaaggtccagattcggacttgatggataaagtatcgacacctgtgccatacactaaaaatcaaattgcaaaaggggttagtagatctgaagttgttaacaaccaaactcaaaacaatgctctttgggagcaagatagacgaaaggttttaggtttacaaacatatattaaaacactgcaagaaaaaggtattattgctgaataaggagggaatgtggcaaagaaaaaggcagcaggtagtttagctggagtagatattgaagtaaaggctcaaccaggtaaacagactcttgcaatggatttaatgccagaagttatgatttatggtggtgccgctggatgtgtttctgctgaaacggaatatcttacaaaagatggttggagacagattagtgaatattcgggagaagatatttaccaatacaaccctaagaataagcgtttagaattggtaacaccttactttgtagaatacgatttaaatggagataatctatacagaataacaaatggtgtaggattgttccaagaacttagtatggaacaccgttttgtattctataagaaaaagaaatcaaagaaacatttcgagattcttgtaggagatcttattgcattacagcaaataggaaaacccctgcaaggttatgtagaaaatccattcggtaaacgtgttccttttaacatacctggtaaaaagagcacttacttaaaaatacacgaggttatttcaacagatgataagaaatattgttttgagactccaagcagctatattgtctttagacgtggcgatcactgcttcgttactgggaatagcggcaagtctcgtctgctattgctgaaagctttaaaatacgcctacaaagaccctttgtttggtggaatacttttccgtaagaacaccactgctcaccgtaaaccaggtggtctgtttacagaagcaaaacgtttgtatcttcctttacaaccgcacgtaaaagaaagtacaatggatatcatttttgaagccactggtggtggaaccctcaaatttgaccatttggaaaatgataacgtaacagcagaaacaaaccatcagggtacacagtattcaatggtaggttttgacgagttaacccacttcacgcaatatgaaatgctctatcttctgggacgtatgcgttcagaatcagaaacaagcttcatgttgtgcacatgtaaccccgatgcagatagttgggttttgaattgggtattaccttatctcgatgagggtggttatcctagagaagatatgtgtggtaaacaaaaatatttcatcattgttaacgatgaacctgtttttgctgatacacctgaagaactgaaagaaaaatatccagaaaactgtttcatggaaaaccctaatacaggggagacagttgttattgaaccacaaactttcgtatttatcggtgggacaatatttgataacccagaattgattaggcttaaccctaattatttagcacagcttaaatctcaaacagcaatcaaaagagcacaactcttggacggctgttggtttgcacgtatacagaaagagtctttcttccaacgtgaatggttgcataagatatcttataaagatgttcctaataatcttaaactaatgcgagcatgggataaagctgtttcagttcctacagaaacttatcgttatccagactatacaacatctgtcaaaatgggtaaagaccaagatggtaatatctacatctttggtgactatgattatgatgctgtggatgagaaaagtaaaattttcggaaggtttcgaagattacctggggaaagggataacctgattctaaatcaatgtaagattgatggaccagaagttacagtagttcttcctaaagacccatctggtgctgggacaatagaatatacagagtctgcaaagaaacttattctagagggttttgttgttaaaccagatgctatgccaggcaacaagaaaaagcttcagcgttttatgccttttagtagtgcgtgtcaaaacggttttgtttatattgttgaagattctttccctaatgtggaaactttaacccacttttataaagaattggaatctttcaatggtgaaagatctacagccactattaaagatgacattcccgatgctgctgcttcttgtttcaatactctgtcaaaagagaatactttcaaagcagtagcaatccctgcaacaacaaatgctcctacaggatacagtagaatgaacagcggatttcaccaaccgtatagtgtccgtaaaagataattgttgacaaaagtcactttaaagtgtattataactagataggtgaggttgtatataatacagccttgccttaacgattttatacctgactggaggaacaagtgtcaacaggaaaaaaaacgtacactaaaaagtcagaatactgggacaaaggtgctgcaaataaagctgctctctctccaacaaaagaggcagagaaagagaaaacgttactcctgtcacctgaaataggaacgatcggattaaactcaatcaaagcatttacgaatttcatgcaaccttatgagactcgtttcccagaatgtattcgcacttttaaagagatgggtgaagaccctgatgtagctactgctcttgacgctacatatatctttgtagatagagcattctttgatttcaagataaaatacaatgtaaactcggcaaagtcaagaaaagctgctaagtttattgattacatgttacgcaatatgcaagcccctctacgtcaatatgttagatcacttttgacatataagcaatatggttttgcattcgcagagaaagtttatgagttggatgaagatcctaaaagtccttactttgggtattggagattgaccaaactggcttttagaccacaagacactcttcacatggctcaaccttttacatattcggcagacggacgttctattctatctgttaaccagaatatcaccaatacgatgttagctccaggtaatacaactttagaaactggtattaaagaaattcctttcagtaaagttttatttgttggtagcaacattacagagaataacccactaggagttagtccgcttttagctgtatatcgtagctggcgtgaaaaatctcttattcaggaatttgaggttattggggtatctaaagatttaggtggtatgccagttcttaaggttccaagtgacattctaaacagggcatctttagatcctgctggggatgaagcacaatctcttcgagttctccaagccaacatcgctaacctgcactctggtgagcaagcctacatggtattgccttcagacgtttatgaaggcacagtgatgcgtcaatacgatcttgtattccaaggtgttgatggcacgggtaaacagtttgacactcaagcactaatcaaacaacgcaaactggatatttataaccgctttggtgcaggtgtgttgattatgggtgatggtgatgcaggaagttttgcgctttctgacaacaaacaaacactattgtctcattttattgagcgagatgtagatattgttgtagaagctataaactctcaactgatccctcaaacactacgactaaacaatatcttcctttctgatgaagatatgcctaagtttgtcagtggtgaaatgggtgatcctgatattgaagtaaatgctaaagctattcagcaattggtggcctctggtgcaatacctttaaccccagaagttattaacgagttccttgaaaaaattggttttgaatatcgcatccctgatgatattgttgccaataaagagaaattctttgaattcatggataactatatgcctgacaaaacttcacgatcaggagatggtttagctacagcgggaactggaacgtctgatactgtttctgctttagatccttcagcacaaaacctgtcgaattaaaaatatttaatattttttaatttttctattgacaaaacaacaaatatcctgtagactaagatttatgggatatctgtttttaagaggtttcaaatggaactcaataaagatacactgtgggaactcttcaaaacctttgctggttttaaagagaattctgaatcccaacaagattctataccatctcaaaaacctgaaactttaatcaaacaaaataaatttgatgaagaaaagatgcaggttattgaggtcttgtattgtccacctgaagaagacgatctccacggagagcgaatgtctgatttggaaatcaggaagatggttgacaacttcaatgagaacattaccaatattagtggtaatcttggtcacatgaagaacaccgataagttttctccaattaaagcttgggtaaatgaagtcgattgttacattggtgacgaactcgttgtggaaggaactcccctcgttaaaatccaattcaacgaccctgaattatatcaagctcgtaaagacggcgttcttaaaggtttgagtataggcgcaatgggcgttaaagtcaagaaggactaatcgtggcaaatacatatttaactaacgtagacttttcaggaaaagctacggaagagtcactaggtgcgcatattgcttacacttttgattttcaaggtggagcagcatctggttataatactccccttttatttaagtcagacggatctccagacataacttttgaaaagttagaagctctcactaaaatgggagaagatgttacagagttacgtaaaagctatattcaacaagtaatggatcgcatttctgaaaaagtgcgtgaaaaatttgaagctggttgggattgggtttacgttattgatgctgacttcgatgcgaacgttgcaattttctgttcagataatggtatgttctctgttggctttaaagttgacggactgaatgttgaagttgaagaggttgctaaacctgttgttcgtgttactgattatcaagttgttgatggtgatgtaatgatctccattgatttctttgaggacgttttagacgatgctttgagtaatctcgttaagagttccttgaaacaaagtcaagttaaagattatttagtgaaagctcacgctaaagctaatacaaactctgtggatgcagaggctaaccccgcaggtgataaatctgcaaacacaactggaatcaataaaggagaaacccctttggaaaatatcaacaaagaagaattcctgaaatctgctgaattccaagaactgatgaaagcacagatcgctgaagctgtagaaaaagcagccgcagatgcacgtgcagccgcagaacttgaagcacaggaaaaaatcgctaaggcagaacaggaagcagaagaacttcgtaaagctgaacaagctcgtatcgaagaagaatatacaactgttgttaaatcctattctttcgtagaagaagacaaagttgaagctctcgttaaatatctggtagataataaagatatcgctgaaactatcgtcaaagcattcgaaaaagcacgtgcagaagtggacgcagttaagaaagaatttggagcagaacgtggtgttgatgtgatcaatactcaacctgtagctaaatcttcttctgaactgattagtcagaaagctgctgaacttaaaaaagcccagaaacaataatcttaggagattaaattaaatggctaaaggaattactttatctaactctcgccaggaattcggacacctggttctgggtggagtgtttagctctgaccttggacactgtgtacgtgaagttaacctggttaaaacagcaaccatgaaaattggttctatcctgaaagctgacaacactgaagctgctaaagctgaagctgccgatgctgctaaagttctgatttggactgatgctctgttcggtattgatgatgtagcagtaggtgacactttcaccgcagttgttggcgtacgtgatcttactctgaaccgctttgcagtatactacaaagatggctccctggtagatgacgctggcgtagcagcacttgaaacacatgatctgaaactgactgaaaaagtcgttttcacttcttaaagtacgaggaggtaaatatatatgtctggtggtgacggtcgtggtcacaactctggtgctcacaacaccggtggtaacatcaacggtggtccgaccggtctgggtggtaacggtggtgcttctgacggttctggttggtcttctgaaaacaacccgtggggtggtggttctggttctggtgttcactggggtggtggttcaggtcacggtaacggtggtggtaactctaactctggtggtggttctaactcttctgttgctgctccgatggctttcggtttcccggctctggctgctccgggtgctggtaccctgggtatctctgtttctggtgaagctctgtctgctgctatcgctgacatcttcgctgctctgaaaggtccgttcaaattctctgcttggggtatcgctctgtacggtatcctgccgtctgaaatcgctaaagacgacccgaacatgatgtctaaaatcgttacctctctgccggctgaaaccgttaccaacgttcaggtttctaccctgccgctggaccaggctaccgtttctgttaccaaacgtgttaccgacgttgttaaagacacccgtcagcacatcgctgttgttgctggtgttccgatgtctgttccggttgttaacgctaaaccgacccgtaccccgggtgttttccacgcttctttcccgggtgttccgtctctgaccgtttctaccgttaaaggtctgccggtttctaccaccctgccgcgtggtatcaccgaagacaaaggtcgtaccgctgttccggctggtttcaccttcggtggtggttctcacgaagctgttatccgtttcccgaaagaatctggtcagaaaccggtttacgtttctgttaccgacgttctgaccccggctcaggttaaacagcgtcaggacgaagaaaaacgtctgcagcaggaatggaacgacgctcacccggttgaagttgctgaacgtaactacgaacaggctcgtgctgaactgaaccaggctaacaaagacgttgctcgtaaccaggaacgtcaggctaaagctgttcaggtttacaactctcgtaaatctgaactggacgctgctaacaaaaccctggctgacgctaaagctgaaatcaaacagttcgaacgtttcgctcgtgaaccgatggctgctggtcaccgtatgtggcagatggctggtctgaaagctcagcgtgctcagaccgacgttaacaacaaaaaagctgctttcgacgctgctgctaaagaaaaatctgacgctgacgttgctctgtcttctgctctggaacgtcgtaaacagaaagaaaacaaagaaaaagacgctaaagctaaactggacaaagaatctaaacgtaacaaaccgggtaaagctaccggtaaaggtaaaccggttaacaacaaatggctgaacaacgctggtaaagacctgggttctccggttccggaccgtatcgctaacaaactgcgtgacaaagaattcaaatctttcgacgacttccgtaaaaaattctgggaagaagtttctaaagacccggaactgtctaaacagttctctcgtaacaacaacgaccgtatgaaagttggtaaagctccgaaaacccgtacccaggacgtttctggtaaacgtacctctttcgaactgcaccacgaaaaaccgatctctcagaacggtggtgtttacgacatggacaacatctctgttgttaccccgaaacgtcacatcgacatccaccgtggtaaatgattttaataggagattaatataatgccagcagtaattttagatcaggttgtagatttcagtcctatgatcgaacttcaggattcccctgatacactgattgccagcctgaatctgttcagcgttgactatcattcaactaccgctattgaaatcggtaaagaaaaagctgaagatgcgctgatctccgctcgtgagcgtggtggtgagcgtaacttcctgaccatgaaaaatccagaactgaaagcgttccgtattccgttcttccctctggataaaaacatcaaagctcaagatattcaatctttccgtagctttgcgatggcaggaatcaatgactctctgcgcacagacgctgaagttgttaaccgctatatgtcccagattctgcgtgacgtagcaaaaaccaaagagaaaatctttgcagaagcagttatgggtcgtgcctataacggcgtaggtggtgcagctaactctgcatacaactggtataccgagtggaatgctacccagaaatctgttgctgtagactttgcttctaccactgtttctccagcagccactatcgagcaagaagctcgtgcttacatcatcgatactaaacaagatggctctaccgctactcgtatcgtagctctgtgttctcgtgaatttttcgcatctctggttaactctccgtttgttcgccaggcatatcagtatttccagggaacccctaaccttctgcgtgaccgccttagcggtaacatggatgttcaggtgttcgaatggaacggtgtaacttacattgaagatatccacggtaacatccctgctggtgaagcatatgttctgcctatgggtatcgaaggtatgttccaggcgcactacgctcctgcggatactccagaactggctaacacccaggctcgtgaactgtataccttcatgatcagccagcatcgcaccattcagcttcagtctgaattctcgctgctcgcagttaacacccgtccagaactggtagttaaactgactactgcttaatagaactctgttaatattagaggctcgtccgtgatgggcgagccttttctgtttacaataagagtttacaatgaagagattgatatgtcaaatccagaattgaaacgttactttagttatcacgaaatgattcgtgatttcgaatcgctttcaccactgatcgatgctgataaaacattagtatctgcgccaccaatgtctttctatctgaaagatggtcgtattgcattaggtggaaacttcattcacttcctcacacgtttgagagaagaaacaggtattcttgtgcatccttttgcaagtgaagaacacatgggttactatcttgtaagttacgaagattatacacctgtaaaaatcaaagaagaagttttaaaagtagaagcggtagacactccagctaaaaaacgttcccttcgtaaaaaataaggtgggcttatgctgaatgcggtagagttggcaccactgatccgaattcttgtttataacccttctcaagaagtattgccagatgcaatgctgattcagatcatccagacttggattgatattatagggaatgaagataaggacaagtgtgcagtattgtggaacagtttgatttctgttttagagtatttatggaacaacgatgttcttaataacaatactcaaacaggaggagctatgtcccgcagagaaaagatgggtgaagtcgaagttgaagttaaatttaacaacggtcaagtaacttataagtctccgtgggaagatatttatcataactatttaaatggtcttatggttattcctgggtgcacggcaggacgaggagcaaccagtaaagttcttattggtggtgttgatgctcgtgagattgatcgagtaaacagcgatcctaactctgtaaatggtcttggtaatgttgcaagtgttgatcgtaatacacgcaacgttaattatttgcgaaattatggacctgtttctttttatcgtagggacaaataatggaaagtgagatcttaccaggtgatgatacggattggcaaaccattatcaaaaagatgatggaccttgaacaagttcaaatcgaagctggttttttaacaaacaaaaggcatcctgaatcagatctcactattcctgcaatagcagctattcaacaatatggtaatgaaacaaataacatacctgctcgcccttttataacagatggtgctgttatctcacagaacaatatcgctaaaaagatgaagcaggtgtttgcaaattacttaatgaataatgtcgggttagctgtttttgagcctatagcgagagcctctagagaaggaatagctcaagcgattgcaatgcaacgttatcgtcctttatctcctgtgacaattaagatacgacaagataaaggcaactattctaatcatatcttaatagatactgcatacatgataaatgcaatcgaaacaaaaatcacaaaaagcaagtctaaaaaataacttgcataaactttgtttttgatgtatactaaaaaggagatacaagtgttactagatcaatttactcttcttgatctaactgaataccaaggtcgtagacgaatctacaaagaggcagttgattcagttattgctaacttagacagtagtgtagaatatgaaccatttactattgaagcggcaagcttacaaccgatatctggtaaaacactgaatgcactacctgaaggttacagatctaaggctcaatatagtttctggactaaaacagaaatgaagggattacaacaaggaacagaacagttatcagatcagatactgatagatggtaaatggtattctgtttattcccttaaagattggaccagaacatctttcttagtccatcatcactgtgttgcaatattagacgatcaaaacaactcctggtcttatggaacagaaggaggaaactttggctaatatttaccaacaaatagaagcatacgaaaatgccatctacttaaatataggtggcttccttcaagaattagtggggttgccagtctatgttatggataagccattcattaaaccggatactccttacctagcactacgtattatcacttccagcgattctggaggttggtcttaccgaagctctattcaaaatgatatgtattcctacgagatggataatacctacgagattgaacttgtagcctatcgtggaagacctaccactttgatgagctatgttctggctgctctccgtggtgcagaggaattaaaatacaaacatctctattctaaaggtcttggttttttaggagcctctaatatagctcaagccaatacgattgtagacggagataagactgaattaagagcgcgtatggttatgacgttcaacactcgtatgagtattgaagatattgctactacaccaatagaagcaatcaacatgcacatccgttcattcagagatagttacaatgatcctatccctttagatttaattctaaacagggtttatgcaattactttggttccaggcgaatactcgtcagttaatcaaaatggatcattatttaacaaccctaccgaataaactcattggaattaagtttctaacaggagcataaatggcaacttttcgtgaaaaggtagcaaccgtaactttactgtatggtgctacatcaattcgtgaaacccagttcgatattcctctgatccttacaggtcagaacgtaactggcgaagcgattcaatattactcttcttccgatgcacttttggaagcaggttatggattaaatgatccagcgtatattatggcagtcaaactgtttaacggtttgttcccaccagatcaagtcatggttggtaagcgtgaagttacaaactttactctaactccaatcgtagaagatagtgcaacttacacaattaccatcaaaaatggtaccaagaaaaaagaatttaaattcattgctgatgacactgcaactgcacaagagattgtagttggtctgactgaaatgatcaatgcagatcttgtttatggcccactgtttacagtagctaacaacggcgctgcaatgactttcactccagtagaaggtaagtttggttctattgacagcacaggtttcactcaagaaactgtctatgctaatgctattacggaagatatcgctgctctgcatgatattgatagtagctggttctggaccctttcagattcccatgaaacagaagatgttctagctttggctgcatgggtagaagagaatgataaagtttacttcttctctagctctgaacctggaattaaaacgaaagcagaagataacgttctggaacgactgaatgatctcggttataataacacttgctttgctttgtggatgaccgatgcagattctgtattcccagaagcagcagttgttggtgcaatctgttctcgtcaacctggtttaactactcttcacggtaaaacactagtaggtgtagagatcgagaaactggatcagacttcggaaaacaatattgttcaacagaacggtaacatctatcgtaaagagcatggaactctgttctatcgtgatggattgatggttagcggtttctttgttgactatgttgttcatgctttgtggtttaaagctcgcacagaagaatcactgtttacactgtttaaacaacagtctatgctgggtggtggtgttcgtgctacttcaaacggtctggctttgattcgacaagctgttctggctaacccgatccaagtaggtatcctcaacggttccatcgctaatgaagttgttacttctgaagagactggtttgcgtgtcgatctgaaacctattgtttatattccttctcgtgccgatatgaccgatgcgcaaatcaatgctcgtctggttgatgggatgaagattgaatatgtttacgctggcttcttccattacgttaaagttcaggtcaacgtcctgactaaccgtactgcaaactaatacggcgggggttaagcccccgttatcaaaataaagaggatctataatggataaaatgcttactggcgtaatggcctacgacccatctcaagttatcctttcattaggtggttgggaaccgtggggttttgcggctgatactaaaatcgttattgctaaatctaacgatattatcaacccttattcagggactgatggggacgtttcattagctttgagtcgtaaccgtttgggaacactcacaatgtctttgcaacgcacatctccagctaacgaagtacttgcaacatatgcacaaacaatgtattctactcgtcaagtagcattcagtgtttacttggaagacccacgtggctattacattagcacgattggatggattcaaagtcagcctgaagatactattggcgaaatgattacagagaaccaatgggttattggtcttaaagatgcaagccttctgcgtaatgaagttggtgtaggtttgagcacccttaactcaatctctgctctgacaattcaataataaataaagggcagaaatgccctttttatcattagagaggaaaatatgtcacaagaacaagataacacaattcaaaaatatgctcgaccagaagaagtagttgagattccgttggatggaaacagatctgttactttccgtattatgaagtggagtccatctaaagtgtttgacaggattccagaattaggtagtgttctggttgttcctatgactatgtatagcacagcaacaatgtccgcagacgaagaccttgagtcacgtattgctatggcactgatccaactttttgcaggtttggaagaaaagaatttaactgtctttttgcgtaaaattttagatgaggtttatactcaagacggttataacgttgcagaaaattttgatgaattatttatggctcacccagaactagtgttagatcttactgctaaagttctggaggtaaactacggcccttttttcaaacgaggtttcggaaaactgttcacacagcttcaggcgatgacgagtttagcagcaaattaacacctgcgattgaacatgctatcgacacagcaacgaaaacccttactttgaagtggtatgaggttattctttgcaaagtcgttaaagatacctcggaaacactgaaaacattagataactacggtgtagattatcttttaaaactatatgagtatttaacatacgaagagtatgttgaagccatgtatgttaaagacacttcaataaagagaaaacatcaaaaccagacaaataaaatgtcagatttgtttaagaaacttgtttaatccaacacgaggaacatactttgttagaaattaacgcctccagaattagtaacgtggttacgtttaaggtggacaagaacagtctcaaggaagcaaaagatgccgtgttgagtgttcagaagtttgcaaataaaatgcaacccactatgaacatgaccaagtttagacaacaaatgaaagagattgagcgtgaacttaagaaagctcaaactcaaagccaaaaacctatgcgagcacctactcccgctggagcgggtgctcctgtaggtggttctggtagacctagaactcctaaaaccccacaaggtagagaagaagaaaaagctcgtaaagcggctgaacgagaagctaaagcagcagcacgtagggaagacttaggtaatcttcgtttacagaactttaactaccgagcaagagcatttagtaaagcaagtcctggtgctatgcaagaagctagagacgttatgggtaaagctgtagagcaatacaaaaagggtgaaataactcttcaacgtatgaaccaagctcttgctcaccagttggatgctttacgcagatctcatcgtgaaaagaatgctgaaatagaagacgaggttcgcggtcgtcgccgtattcgtagagagctagaagcagaagctaaaatgcgtatacgtatgcgaaatcgtgaacttagagatatagaacgcaaccgtaagcgtgaattagctcaacaaaaacgtgatcgtgatcgtagatacggacaattaaaagaaggtgcagcaggtcttaatccacgtatgattgcatcctctttgataggtgctggtctgtttgcagggggttctgtagttggtaacacgttgatgaatactaacgaaagaattaaacttgtaagccgtggtgctgaaaacgttcagacaaacgccaacgctattttggcaatgacagcttggggtgaacagaacggtgtagactctgcaaatattattaaatcaatagataatattaaagacgttcgtgaacgtcttggtaataccgttttagctgcaaagtggaatgagaaagaagggaagtggaaaggcggtgataatggcataaatgacattatgaacttgttcggatggaatccagaacagcttaaacctttacagaacgatcctttagcttttattcaggctactgttaatgaaggtgagcgtcgaggtatgaactctgctcaaatcgggcgacttcttgaaaaccttggtgatgaccttatgcactaccaacgtatgtttagtaaaaacggcgaagggtataatgaagtattgaaaatgcttcaaagaacaggtgcaacattaactcaagaacaaatagatgcttctaaagagtttactcgttttgctgcaacagttcagcttgtaggtcaaggtatgcagaaccacttcttagagggttttgtgaaagccttacctaaagatgattcttggttggataacgttaaagtgctagatcagtttgccaaagatttaggtgaagaactcggtaagacaacagttcaattaggaggttttgctaaagaattgggagatggtttcggatcttttaccaattggcttaaagaaacattcccagataccttcggagacaacacagatcctaataaatctatggcacaaaaagcatacgaggcaacgcaaagtggagacagcaatcctgtagcagattggttgtacaatttaacaggtattgatacacaagatattggtcgtatgtggagaggagaacaaacaaggacacgtgcttttggatttggtaatcctcttgaagatttacgtgaatcagcctatacacctaacgtaagtttggctcgtaatcaacctgttgttgagaatacggtagcaataccaagtgatcttatcaaagttacgatcagcccttcttcagagtttggaaatattcttgatgcaagaattcaaaatagcggaaatagcattttccaacgtttgtctctttcaactctaagtggacaatctaacactggtggttaataaaatacctcgcttcggcggggttttttcgtttcccttgacacgaagtttctatatgtgttacaataatcaatatgggaagatcttgcatcttccttttggcattatcattactacgaggttatcatggcagcaatgactccacaacagtcggtgagagccgtctataaggcagaacaggaaatcaactctaccgagaataaaaatacctcggcatctactgtaaagggtgataatggtttctgcattttagcaagtgtttataatagttcaagtgatcaatacattcaaaactttaaagcaattactttcgattcggtccctgaagtaggtgtaactcgtgaggcagatgttacaagttttccagtagaatcaggatcggatgtaagtgaccacgttcaaataaaaaacaacagatttaaactttcaggtataatcaccgaaacaccaattcggcttatgcgagatcaattatacagtgcaggtgtaaatggggcaaggatttctcaagcaatagaatatctagatcaaatatttgagtcaagacaaccaatagttcttttgacagaacacaggacttttgaaaatgttattctgaaaggctactcttatgattataaatctgaatttgctatgcaatttgatttagagttcgaacaaattcgtctagtctctaaggccactactaacgctattgctgtaaaaacagcaccaaataagtcaactggtggtgatgtgaaaggtcaagtcgcttctaatggtcctaagtcagatattacagtaagaactgctgaagctactaataccccaacaaacaacggaggttaatagtgacaacttattctaaaacaacaaggtctacaagtaatactggctacagtgcagtttatctggaggaccattctacttattttgcatggtatctgaaaactgaagagtaccctgatcaaacatatacagttacattggatggagttgattatgacattcgtttaaggtggaacactagggacgagtcttggcaatgccagataggattatctggagatgatccaagtataagtttcaaagttacaaatggtttagatcttcttaaaccttataaatatcttgaaagtgtgccggatggtcaattgtatatagtagatacagttaagattaatggtcgtcctgggtatacaactacaggtcgagataaacgttttgtattggtttatattgataacaaacctaatcaggcgtaaggagataatatggcagaaagagagtatacaaaagctcctgcccctaatttaaacagggcatacaaattattaattggttctgccacaaacacaatacagaagagaactaagaactcggcatttaaatctacagtagatttggataccaagttagggacaacagaaaaatcctcttctaatttgtatttgttgcaagaccatcaaataaccttcagtattaagaaagataataacaaagatcctaaccaagcagagattgtagtttataacctttcggatgatactgttaactatataaaccgtggtatccgaaataacttggctgttgctttagcggtaggatacgaaggtgaagagttggttatggtcttcaaaggaactatccagtgggttagtgatacttttgactcggtagacaggaaaaccactttacactgtttggatggcggtattaacattgcagaagcaagaacaagccgcagttatccaaaaggaactaaaatcaaacgtgttgttacagatttggtaaaggatttaggaactacagaaggtaatatacacgtagataatgatcaaaccttatcttcagcaacagctatgtgtggaaacacttcacattacctagaacatatttgtaaaagtattgatcacaatgtgtcaatacaagatggatctgtttatgtcactcctcgttcacaaatgtctagtgcacgtagcgcctatattagtcctgaaactggtctgataggaagtccagaaccattccacaacgatataaaacctactaaaaaagttaccaagtcctctaagaaggcaaagaaacctacagacggtgttaaattcaaatgccaaatgaatggtgcaatattaccagaaaaaacaatctggttaaaaagccgagattatgatggtccatttaaagttgtttctgtttctcacaatggtgataaagagggtaaagagtgggttactgaagtggagtgtgtatccgtgtctgaaataatgactaaggagaaataatggatgcattgaattttgtcacagcaatgcgtggcttaatgacagagcaattagcagaagtccatacagccttgccagtccgtgtgactggcgttaattatggtgctaaaactgtcactttagaatctattgttaaaaacacacgatctagtgaagatgaaatagattatcctacttttgaagacgttccttttatggttaatggtggtgggacaggaagaatctcattccctattaaagctggcgatttaggaactgttatattttctgaaagagatccttctaatgcactgcaaactagtggggaaacctcttcgtcatccacttttatgcagccttgtggattataccctatttgttttattcccaaaatagctacaggaacagattcaacagaagctgtagattctgaaaaggtagttatttctaataacaaaaacacgtacgcttctttcgaccctacaggtaatatttcaatatggaatagtcaagggatgaaaatagatattactacctccggtattactattacagatggcacagggactttggatctaaaaggtggtaatttaactttcaaaggcggcgtagcagatattaatggtcttaaaatagatcagaacggtttgatgacagatggtaatggcatcggattccatactcacacgcacacggttcgtaacattcagagcggtaactcaagtgccgagtccttaaaaccaacaggagcctaacatgggaatcccttttgacttaaaacttgggccaaacaacgacctcatcatggatgatggagatttggtcctcactacaaccagaacagaaattgcagcacaaactcttgggataactctgaacacgtatcgtggggagtggtttttaaatactaacttcggtgttccttacttacaagagattattggtgttgctagaaagaaagatattgtagacagaatatttttagcagagattgccaaaaacgtttacatagatacaataaacagttataaatctgcttatgacatggatcaacgttattactcaatgacagttatggtcacagtaggagcagatacagtaacatctatattcaatactcaaccttctgaagagtttatttaccctgaagctggtgaagacaatgcagcgatcatttgtgaagcttacagtattgttgagaattcgaatagactttatcgctttatcaactttgttggtttgccacgtgatacctactctacttggtggaatgaatggtctacagagtcagcagtggaaagaatcatggttaacgaaaaaggtgatgcattagctacaaacaataatttcggtataacagctatgacaggagtagaagagtaatggcagatttaactacgatcaaaatttctgatcttacacaaacaacctctgtgtctgatacagatttctttgtaacagatcaggctggaataacaaagaaaacttctttgaaagtgttgttgaatggtgcaggggtaactagaaaccgtctgaatgcacggggaacagtaactagtaccttggcattagatattagttcagcagaatatttttcggcaaccttatcttctgcaacgtgcacaattagttttactaatattccagtagcaacgaatgcagttttaaactttactttatctttgcgtcaaggaagtggcgcaaataaagtcgtatggccttcttctgtaaaatggagttttggtcgttccccagttttgagttatcgtcaaggtgcaacagacacttttgagtttatcagttatgataatggtgcaacttggacaggtagcttagttttagcaggagttatttaatgtcaagagttaagcacaatattgacaacacgtttcagttgattgaagggttggttcagtttttggaaagaaatactgggcttaccatagatcctacggttcagcactacattatcaacccacaaaacgtattggcgaacaacagacactttattaactggacagcgcaggaagggcaaccaaacggtgacgctactaccgaaggtcaatctgtgcttatcactggttttgcttatgcatatttggctacaggggataaaaaatatctcgaatctgccgagaagtattggcaagcctatatagatcacttcttcgggggccaacctattcctgatcctccggctaaatatcgtcccaattggatcatcaatggtaaagaaccacgtttagcacattaccctctcacagacgatgggtatcctacgcacggtgggttcaaaggtagcatgatgacttggattaacggaagaactgttattcctaaaggtgcgccacattggggagaatatttagataaagcttggtttgctttcaatggcaatcttggttggaactccgttaacgcaacagtttatgcaattaacccagacggttcaaccaactggaaagaatatggagatcagtgggacgttgaatggattatagatcgtctaggacgtaaagttgattgggatggtaacattttatctacaggtcacagctttgcagaatatggaacagtgcaacttaaaaatgcttctgtgaacggggattataaattcaactatgctacatgcaaccctgtagaacacggtggatatctgcttaagcgtaatgagatgtggcataaccgtcctgtaaacgttccggtagagttaggttatcaagataatgcttccgatgctgaaacgtggtggtgcgatgcaaactacttgatgtatcagatcacaggggagagaaaatattggctttgctggcaatcttctttattgctgtgtcaagactactcaaacattgatatgtttgataaattcttccgtagatctacgacagcaataattccttttacagatggtatatcttatgattactcatatccatctacagcaatacctaaatactctcgtgacgaattaggatacacagtaattcgccaagatgttgcagcacaaacaactttagaacaacaggcagtttggttcagagtggatcagaattcaaaactgcgtattgagttccaaggcgtagatgatgcaggggaaggtattcttttccgtccagagttagaattaagcaagactaagagtgaaacagacacagtgacatatcgttgtggcttacctcttggtgcagctaatgtgactaagatggatatacctttatccagttttatgcgcaccgaacctcctggaggtggtgtatatattattgctgaacctagaatcattgttgactggggaagcaatactgtgatacaatataaatatgcaactggtattgctgggacaaatagtgatcagatagtttctgctaatatggattcagatggtggttttactgttgggttttggttaacaccaactaaaacagccaatttaaaatctattacgtatcgttcatacgcagatgattttaacatcactattacggattccgcaggttggagatggtgggccatgttagaaaaaacaaattctacatgggttactaaagctttaagtcctgctgatttcaaattaagtacttggcaacctaatcacgatgacacagagacaaaaccttcgtcaataaacctgactgctattgatcagatcaatattgcattggattctgaacctgcaaatggcttgacaggggcaatcgatttttattgcgttaacgatatcccatctttgtattcttcagccactggtgatgattacacaatgtatttcagggttacagtttcatctgaaaatccttatacagcaaaacttggagattgtacaatactggactacaaacttgacagtttgaattatactccaggaatcattccattttctaatattagtgatcctaacacagcattatatgacggttggcgcggtattccttacccaggttatcaatacccatccttatattgttttaaagggagagatattgattgggttcgtatgaacaacagtatagactttttatatgattcacaaatgtggttttataataagtttgcccctgtgatgcctgggccaatggcacaagcttatgtttgggatcgttgggatgctcataaatacggaaacaagaatgagttcacaatgtatcattggaacgataaagcttgggatgggtatgaagcacgagcattcttctgtgcgtgtcatacagtatacgaacttaaacaacgaggagcagaagttcctgaaaaacttttaacagtttgtaaaaactggatcaactatctgaagtggttccaagacaacaacgaaggaagaacaccaacaatattttatcccaatggagaagtggcagcgcctgtagatgactttacaagtcacatgtctgcgctatttatggcaggatgtgctataatggggatggctggatatgattcagaaattcctaacattaaaatagtagcagaccgctgttttgaacttattcaggaaaattatattgttcttggtcctaatcatgttatgaatggctgttggagttccgctcctagaccagatagtgataacggagtcttctttggcttccacgctggagagttgttacgtggttttgggttgtatgctttatacaaaaaacttaatcctcaaaatgcattacctgttttggattcgagcaatattcctgcacttactgttttgacaatggcaaacattagtgttgacgttaccgagtaaggggtaaaatgaaacaagctatatttactgtcacgcgagacaagagagtaaatgcgagttcatttaactacacgactgttgatggaacagcagtcgctggtagagattatattgcaaaatcaggaacacttgtgttccctgatgatgctgattctgctaccattgtggttgaagtatttgaacgaccaaagaactcaatagatcttaacttctccctccaagtttcagggattagtcaaaataatatgatggttgaaacgaccatcaactgtattataactacgattcaagaaaatactactccaataacttggactacaaaagacgttaaaatgttctctcctatgtattggacaatagattctcaagcaacggaaagttgttctattgtatctcatggagactcttttactgcaagatttgtaaacagaacaacagcaggtttggcaggggttatctggagcacagttgacaaatatgaccataaaggtgttgggtatttaccccacacagatttaagttcagagaaactttggtttaaaatggaagttagtcaaaacatgccaggttttaaagaagaacctttggtgccaactttgactgtaactctcttggataaaagtgtccactatgttagtttaggattttatgcttcagatatttcagaagatggtaaaacagctacaatcaaactagattttggtaatatcttctctggtcctaataatgatattcctttggacatgagtgctgtagataatattttcttctctttgattacagcaaggtatgaagaaatagaagagattgtacctattgatagtcaagaggcttggtttactttcactcttcttgaacctacttctggttatagtatgatgaaagtcagtaaccttgtccagcctgaacatgatattcgcatgtgcacatcttatgacgatatgtataacctgactccagagagagttatttataatacatatgcgctaggttatcgtggaatgattaaccattacaacggaatgtctcactattatgagttctcatggaacggaacatcttgggctttaaatagatctgtcttcctaaatccagctacagaagcttggctaaatagtttccattctatagcgaacgagaagggttacacaataatgaactctttaagttttgagttgatgagcacagtttgtcctgtagaatgggtccagcatgattggaacgatgctcttgcagcaacagggtatgagcctcctagttacgtgttgtctccaactattgacgaaggtatgaaatatttgcaaaatgttattaataaaatagcatctatttcgcaagctaataatattccagttgtcattcaaattggtgagccttggtggtggtataatacagcgagtaaaatgccttgtatatacgattacactactaaactagcattcaacacagaaacaggtttatttgcacaagatgtaggaacaatagataattataaaacaggaacaccgtttgacgaatactatgcatttttgtctcgtaaactaggattaagagttgcaaagtttgcaacagatactagattagcctatcctggagctaaagttacattattaccatttgtgccatccattttaggtaacggtatgatggagtttgttaacttccctaaagattattatatcccagaaaacttcgacttttattgttcagagtgttatgactggttgttggaaggtaagatggaaaaatcttttgacgctatcacaatacctaatgaacaattaggttttagttatgataagatacattatcttgcaggttttgttccagatgctactcttgcacctttgtatggctttgatcctgaatcaaactaccgcacgtatctttggaaaatgattataggtaacatagtgttgaacgccaataagttcaatggccttacacaatatatatgggcctatcctcaaataatgcacgattctatcacggtagttaattctcaatcccaagttttctatatgggtaacgtgcctttgaacgtttatttacaggatatcactcttaaacaggtaaatgttgagattgccaccataagtggaattacattagccactaaatctggagaagatttagtaacaacacaaaaattttatatataggagtaaaaatgtcaactacaattactaatttacccgaaacatcaaaagttaatggttctgattacctggttttagaccaacctgataagactgttaaaagcacagtttccaactttcttactgacactggggtggttttagccacccagttaaaagatatttctggagctaccaagtacccagaacttcaaatgtcacgctggagagatgaaggtgatcctagaggatggggagcagtaggtgacggagcaacagacgataccaatgccataacacagcttcttgctgctatgcctgatggatggattattgatgggcgtaatctcactttcaaggttacaacactaccagatataagcaagtttaaaaacgctgcttttgtttacgagcgtattgttggacaaccccttacttatgtatctgaaggtttcttcgatggaaatctgacaaagattacggatacaccattttacaatgcttggacgcaagataagacgtttgtttatgacaatgttatatatgcaccatttatggctggcgaacgtcatggtgtacaaaacctccatgtagcgtgggttaaatcaggagatgatggacaaacttggtctatgccagaatggttaactccaattcatcctgattataatgcctcttcagcaaacaaagttaactatcattgcatgagtatgggtgtatgtggtaatcgcctatatgcagtcatcgaaacccgttacttatctaacatgcgattgaagaaagcagaactttggtcacgtccaatgccttattatagaaggccaactggaggtataacaattagttctgggtctactacggcgacgattgttttagaaaagcatggtcttaaagttggagatgctgttaacttttccaattcaggtgcaactggtgtatctggaaatatgactgttgcatctgtaattaacaaggatacatttactgttacattagcgagtgctgccacatctaatatagataatacaggaactacttggcattttggaacacgtttctgggatagcccttgggaaattacagaattaccagatgttgcctattctactaatgcagacttatgtgttacagaaacccatagttttacagttatagatgatgataattacacttttgctgtgggttatcacaatggtgatgtttccccaagaagattaggtattttgtatttcaataatgcttactctgacccaagttcttttactcgtagaacgattagtcaagaatatgctgacaatgcagcagaaccctgcattaaatattatgatggaattttatatttaactactaggggtacttcaacttctgttgctggttctacattagcaatgagtgctgaccttggagaaaactggaattacttaagatttcctaacaacgttcatcatacaaacctaccatttgcaaaagttggcaactacctttatatctttggtacagaacgttcatttggagaatgggaaggagaagaactagataatagatataaaggtacgtatcctcgaacgtttatgtgcaagattaatgtatctgtatggcctgcatctttatccgatgttcaatggtttaatatcactgatcagatgtatcaagggcatattgttaattctgcatgtggtgttggttcggtatgtgttaaagatggttggttatattatatctttggaggcgaagatttcttatctccttggtctattggggataatagtaaaaaattatggtacaagcatgatggtcatccagccgatttatatagctatagactaaagattaccgaacatgattttgtatcacgtgatttcaaatatggagctacgccaaaccgtacattgcctgtatctatgggtacggatggggtaaggcatgtctcagcccctgtaacttttgataatgatgtgcaaatacactctttaacagttactggtcttgagcatgatgggacacaacaatctgccgttagaataaaattagatggtgattatggggttgttgcaaaaaatgtcccaataaaaaatccttctgaacagcgactaatcttatgtggaggagaaactccttacgttactgatggatcgctattacaactatatggttcaaaccatacgtatccaaacagagcagttttatatgccccaggaggagcatatacccaaaataatttcatgccatatttagatggacaagttgcattaggtggtgcatctaacagatggtcagaagtgtacgcatctacaggaaccattaatacttcagatggaacattaaaaactaaacctacagagattgaagatattttactgaaagcgtgggaagatattcatgtaatctcttaccaatggctgagtgctatcgcggagaaaggagattctgcgcgtattcattttggtgttatagctcaagatgtaagagatattctgattaattatggtttaatggatgaaaatagcactgattgtaagtatgcttttctgtgttatgatgaataccctgctatgtacgatagtgttgttacaggacaaaaagaaatccctttatttgatgatgaagggaatgttgtaattgatgaagaaggtaatccagtaacaatcgtagaagatgttgtagaaactatcgaaataattccagcaggatcgcgatggggtattcgcgctgaccaaatgttttttattgagatggcttatcaacgtaaaaagttaaaagctcttgaagaaagacttgcaacccttgaaagtaaataataccgcttaggcggtatttcaatctttatatctcacttagaggtactcatggttaaagagaaaaacggttttaaaaaatttattcgcggaatgttctgcacttatcccggcaacggggtaagctctacgaaagtctggaacgctgtaggcatgtcggttatgacaggcatgtttatctttttaggaatagaaaaagaaattcctgaatggatgggttgggcttttgttttcatgataaccccttctcgcctcatgaaaaatcttattgatttacgttggggcagatcacaatctaccaaagaggatgactaatggacgaatatggtttgacagatgcgggatttgtaatcccgacttttgacgatgttttaaacaactacatgacagcagtaaaaaacacatttggtgcagatgcagccacttcggaagatactgtgatcggacaactgtttagaataattgcatacacagattacacattgtgggaaggtatgcaaggggtttataatactcaaacactggatggtgcagaaggtatttatcttgacgaaatcttttctaaacgtggtttctatcgagcaggggcagcagcaagcacaggttatgcatatgttaagagtaataacaaagcagcttggacttatgagctaggcacggatatttacttcaactctgatagcgatatgaactattatgttagcacaccaactatgttgaatgctaagattgcagcttatcaaatctctcgtgctaatgcaactgctacaggtgttccaaatattactttttatgcacaaagtgcggtggatggaggactaaacagtaaaacacttgcacctggttcttctacatttataaccgatcttgaaacttttatcaaggcgaatttaacagaagctgatcgtagtcttgtattttctgattcaggtaacttatcaattggttttacttctttaaccagtgatactccagtggggctggtaactcctattaaattttatgctagtgttccggttggaaccaagtggagtgagattccggtagttgcagcagagaaaggatacaatcctgttggtgtggagtctattacaggaatatcttctacctttacaggttatcttgacagcggtaacttctattcattttctcctggtcgagatgttgagacagacgcagaattccgctctcgtttcaatgacaatgttgatgaagctaacgcagggacacgagcagctattgtgaaagctctgctacttacagatggtgttactaaggtgaagatttacgataaccctacgttacatgatcaagaacatgctccggctatgactttccagactatagtttatggagggagtgctgaagaagttgctgaagttatttacaaaactaaaccaatcaacagtttgacacatggaacaaccaacataactgttacaacggaagacggaggacaagaaattattcgtttttctcctggtgcttctgctacgtattccgtaaaacttgtttatcaaactgtcaacggaacaactttaagtggaacagaaaaacaaaacattgtagaagctttacaaaacctgcaagcttattttgaattaggttcttcagtaacgaacgatcaaatcaaaggtgttatttatgcagcacttgcttttggacgcttgacttctcttcgtgtttatgttaaacttaatactgaggatgacagtaaatatacagagaataatatagttcctgcttataatgttgtcccttcttttgaccttgataacatttcttacgagtatggagtgtaaaaatggcagtgagtgttgaccatgtaacaacttgggccagtatcaatgaagacgttaaaaaccttctgattgaagattttaaatcttctcctaacattgtcaagctcctctacatcgtatccagtgaaaagcaaaagatagatcaggcaatgatctatcttgctaaacaccgcttgatctctacagccacaggcaaatacctagatattctaggggaagaaatggggatcgaacgtaatggctctgatgatgaagagtatagaacaatattaaaaatcagggcttaccgcgtagcctcatcggggactcgtggtgacataattgatatcttcgcccgtttcacaggaacagagcgtgaaacgcttaatacttacgtaggtttgaataaaacctttgatgtgtttttctacaacctgtgtcttcaatctgatcaagctttagagcagttgctaagtgttttccctattattagtagctaccgtcttggagcaaaagcaggatcagcttttggttttagttcttattatgctaccaaaccgcctcatggtattggtggtttaggttccctgtacatggaatctactggggatgaaacaggacgcatgtgtacgcttctcaagcaaatagattaaggagtttaaatggcgaagccaatatattatcctgactgggctacacaaactgtaacgctcccaggaactttaaacacaaacaaaattagacctaaagaaaccatccgcacagttggtatggattatggtcaaatcatgacttgcgaagaaatgaactggattcttaataatatcggtttatggattcgctatttggtggatgactttcttccaactttacctaatacctacttgcctttagtgggaactaagattacaatggcaggtgatgctactggtgaggctacttggaacggtaacaaagaagttactttatctatccaggttcaagataacagtcataatcacttgtcggcaaacattacggatgccactagttcaacagtaacaccaaacgtgttggtaaaacgtgatgcgggtggtgctatttatggtggtgatgtttatgttaacggtacttccacaacagatcctgcaacactgttcttcaaaaactttgcaggacaaacgaatggtgagatttctgccgagtatcaaagcggaggtcagctttacatctatcgtagaaatcctagcacaggtagtgtatcggcaggtgttcgtttatatgatgcaggttatgttctaatagataatccaagatcaaacagtggacaagacacttctaacggaaatgctttagttcgtttagattatctgaactctcgtttgacttcccttcagaacacattgcagacgaatattaacactgttcaaaacaacttgaataatgttaacaacaacctctcttctcgtataaacaatgtagaaagtaatcatcaaagtcagattacaaataactacaactatgctaacggaacctttgtaagagatattcgttatactagccaaggtgtgtattatccaccagggaacgaggtttcttggacttatatctgttcttctggttatgttctttctggtattatcgtacaggaaacaggacgtagctctgcggataacatcggtggggtttacttcaaacgcctccagcgcaacgttaacggaaactggtacgatattggaggctaaatgatatttacaaactttaaaaaatatattcctgaagaccctgaactaaaagaattggtagaagcagagaacattctttttcttcgttgcgatcaaggttacgactggtatgatttacgtagcacagaattcaataacgataaaatgaaagtcgtttttgatgatcaaaatcgtattgtgttttggaatactgatcctacactactttgccctgaagatctttctatagcacaagtagactttaacatagatacttttgaggatattaggaacaaggttctggatttagaaaccttaactcttaagaataaagagtattcccgtgaagagttgatgacacaagctagtgcaaaaattcgctctttacaagaaacagcggtagcacttataacacctttacagtatgctaaagatttagaaatggctactgaagacgaattagcttatcttaaaaatcttcaagtttatgtagttaaactaaatcgtgttccgcttcaaaaagactatccttacgctatagattggcctacattaccgacagaataagggatcactatggaatttcaagaagcatggggacttgcaaaggatgcaataatccctttaatcggagtcatctggttctttttcaaacaaaaaatggataaattcggctctgatcttgaggaaatggaggagaaaagtcgagagctagagaagaagttggtctttgttgaatcaacttatgcaactaaagccgaacttacccagatgctaaatcaaattaactctacattaatggcaaataataacacccttgagcaaaaaattgaaaagattatggacctcaagaatgcgactatccaaatgatgctagatgacatagttaaacgtacacagaataaggggtaattaatggcaacattcccaacatatccagcaacgtctctcgaacagggcgtagacctggttattttctcatctaaccaactccatgatgttattaatggaagtgctacagagagtattgaaacagaatcagggttgataccaaccctgagaaaagcccttgttgacaactttttctttaaaagcccattggattgggcgcaaggcacaaacgaaacagtttttaaccaacttcgttatttccagaatggagtgttgagtggttattactatgcgcctaatgctacactggtaaacccaattcctatgcaagggactccagtaggagataacaactgggtattgtggggactgaagacagaacaactagcaacagaagtcaccccttgggtatattctggtgcaactggttatgaaacagtaatcagtcctccctacatctttgatagtgctattgttacaatcaatggtgttattcaggttctgggagaagctttccgcatagaagatagtaaaatcattttatctgaacctttgggacatgatcctgcaacaggactgccaaacaagctttttgcctatattggtaaaatcgtagcttccgcagatacagatcctaacttagaaaaccgtcttgtcagtttagaaacaaaaactgaagaactgacagaaagcatggataaagtacctttacaaactattgctcgtaaatacggtttgttggatgatgaagtagcttacgcaacagcgggtcaatcattaacagggattaaagctctgtatgatccagtagcacaatcttcctacacattgcctcctaacatcacagggactttaacatctttgtctgtttctggagtaatgacttattctggcggatctgtagatctttctgcattagctgttgaacgtggacagtttgttcatttgcctacaagctttggtaataatgtaactctgacagctaaaaatcagacgattggacgtggtgctggtcgttatcgttgggctggaagtttaccaaaaagtattttggcctctgacacgttagagacaagcggtggattaggtccaaacgcatgggttctaactaatacggaaggactgttaacccctcgtggtggaacatacaacgatttattcgatgttgtctacttgtcagaatatgctaacaatacaactacctataccacaccagaagcagctttccaggcggcactgttagcagcaaaagcttcgaaaagtaagattctcgatgcttacggttgcgatatgactttcacgacaagctcttttgatattcaaggtatcactttgcgtggtggtgtgttccgtggtcaacgcgactatcgtgtgcagaatgctacagtagaaggcacaactttccgtaactctcgtgttatgtattggggtggtgctgtgcgcatgttcgattgtttgtgggacggtgctcctcgcgcaggtcaagttggtagcttggtattccaaggcaacccaatatcaggtacttttgaaattgataattgtacttttaaaaacgggttatatggcatccttcaacaagggacaggagaaccagtaacacgcggtgtcttccgtaaccttaccttcatggacatgcaaggtgatgcgatagaactgaacgtcatcaataaacattatgatgatggttgtgtgattgagaatatttacctgtctaatatcgatgggactaacgctcctattcctctgtccaactggggtatcggtatcggtgtagctggtaaaggaccatatggttacggaatccctgatgatcaatattgcaagaatattacaattcgtaacgtttttgcaaaacgttgccgtcagattgtccacgtagaagttggtcgtaatatttctatcgaaaacattcatggcgatccagatcaaaccgtatctgttgggacaggtttggcaactggcgcagttgtaatgtatggaagtaaagattttacgattgacggtgtttatggagagcctaaaacagacggtagcacacttgcaagtaatatccgtatgatttatttggagtggggaactaacgcagttctggatgaagagggtaatccggtagttccggcacagggtagaccttcaaacccatgttttaactattctgttcgtaacattcacaccaaaactgggcgtgtttttgcgggagtttccgctgggccaggttatgaaaacagagttagctttgaaaatattcgttgcgctgcattgcagttgttcggtatagcttcttggctttcaatgtctaacatcacctgtaatatcttcgattgtgttggtcaacctgaatctggtccaggaacattttatgatggattcttccgtagagaaaaatctgttcttgaaatggttaacgtaaactgttacccagatggcaagacgatggttactggtcgtccacagtggagccgttgccgttactcggatattcatcgtgtcaactgtaatgttgaagctaatatgtataccaatatcgcaggtggtattggagctattgtagggacaacgggcaaagtttattacttagagcctaatcctagtcgaaacattgatggaatgcatttcccaacagggaaagagtttgacaaaggtgatatgatagtcaaggcggataatacgttcttccttgtaacaacaagtggggcatatattccagatatcccagctttcggtattcgagctacacaagcaggagataccttcctgacacagaacttgactcctaatgggacagcaacaaatgcttcttggttgtatcattaccctctgtcagcagggacacgtatccgtattcctggtgctggcgtaggtggagcagatttggacacagttattactcgtgcaccttatcaagataatgatacgtggactaacccagttaaaatagacattgcagatccaattgtaacgcctacaagtgctggagttagaattaaaaccatacctaatgattccagtaatgtttctgtaggtaatactgcagttattcgcccaacgccagtagtagatgtgccaacaacctaggaatagagggggattccccctcttcttccaatagaatggtctaatgataggagagataaatgaatttaacaagacctaatagtgcgatagccgatcttgtagaagctacttatcgaaaacgtcgcagctttgaggcaggttttacattacgtaattcccgtgaagttttgctgttagcagcagaagggaattattaccaatggaaaggaacttttcctaaagtagttccagcaaactctacgccagccaccacaggtggtatttcttcccttgcatggcaaagtgttgggaccgctgatgatatagcaattatcaatgccaagtttacggcagtgcagcaacagatcgatgatctgtcggaaacaatacctgaagctggtaaatcagcttatcagatcgcacttgataatggttttgttggaacagaagcacaatggcttgcttctttgaaaggagatactggtgctcaacttaatattaaaggatcattagcaagcactagtgagctaccatctacaggtaacgttgcaggggacggttatatcgtaggcgatgtaatctatgcttgggatggttctgtttggaaacttatttcttctcttggaccagaagggaaatcagcttatgaggtatggttggcagatggtaatacaggatctgtttatgattttcttacctctataaaaggtgataaaggtgatgttggtcctacagggccacagggagcacctggtgttaacgccaacggttttgattatcgtggggatttgccttctacaagtaacttaccacaacctaactctgaaaacgtaagccaagcttattctatcaatggtaatctttatgtctctaatgggacagcttgggtcaacatgggtaatattgttggtcctcaaggtccacaaggtgaggcaggtaaagacggtctagatggaacagacggagatgaagggaaatctgcatatcaaagttggctggatgctggtaatgaagggacagaagtagattttgttgcctcacttaaaggtccaaaaggagacaagggtgatcaaggagagcgaggtccacaaggtgaactaggtccacaaggaccagtgggtgcaacaggatcaggcttagagattatcggggttctgaacagtgaagctgaacttcctcctactggagaagtaggtgatgcatataaaattaataatgatttgtatgtttggattcaagatgctacggaatggatgaatgttggcagtcttggaggaacatcaattacagctaaaggtcatgttccgaacagtgaagctctccctgtttataataactatggtgatgcctatttaactgaagacactagtaatctttacatctatacctacgatcaagacaccaattccgcatcttttgttgacatgggaagtattaagggcgacaaaggtgaaaaaggggataaaggagataagggtgatcctggaacaaacggaaccaacggtactgatgggaccaacggtaaggacggcgcacagtggtttgtagcaacaactaatccagtcgcaggagacggtgttatcaatgattacgccttcaatactaccactggagcagtgttcaagaaaacagattcttctacttggacacttataggaactcttcctagtataccagaagcccctcaagacggcttgacgtatggtcgttctgatgggaactggattgaaatatcaggatcagatcctacggaagctataacaccaactagagttacagcaggtttcatggaacttgaaacaactactgccaactctggagcatcttggactccttctggaacttccaatatgtatgttgttacagtaaccgatgctttaacagttggagcatggcctggtgtcactggctctacaaagcctaaagcgttttcagcaatgatttatttgattcaagatacaacgggacacacggttacactagatgcgtcttatggagcactgaatgatacagaaatagcaactactgctaacgcagtaacaattttgcaattaacgtatcctggtgtgggtaatatcgttgacatggttgttgtaacacgataacagaagccccgaaaggggctttctttttatggagggtttaaatgtttccaattccaatatttactattatgactagcactggtgtcgttcctctgccagcaggtattgttaaaaaagtaatcactttagattacccagataacgctggtaattctaacagtagtttagcaattttgcttaatgatggtagattgtttactcaaggcgcaaacctctttggtgagattgcagatggaactcgtagtgcacgattcaataatttccacttagcttctactgtagtagcggatgtgtttaccgcagatcgttgttttgttattaaaactaacagtgggggatggcaatattcaggattgacagcagggttggtaggatctatagcagcaggtggtacggatgcatgtgtaactacctggactagctttccatctgtaataacagggactatttctttagccaatcttaaagaggttaaaggagggtataacaatactctctggttaatgaatagtggtgttctttatggatcgggtcaaaacacagtaggtagtttaggtgcaagcactactaacgaagtttctactcctcgtcagataacaagttcagcagttgcttttgatgcaggttacaaccaatgctcttatgtcaacaatgtgggaaccttgcgtgtttgtggagctagtaaaggtttagcaggtaataataacacaacaaccgcttttgtcaatgccacgatatccactactgaaacagtgtatgtcaaagattacatcaatacagtttcccagacaatagttgtaggagacacctccggtggtacgggcacggtaaactacttatatgtcaggtctaatacagaaacaacctacactaaactggatacctttgcagcaggtttctcaacatggaaatttccaccaagccgccactcttttttcgttgggatcaacaattccttgtgggctattggtaagaactacactgcaaacttaggtttggggtatgattctgcgagcggagatccactccaagtgggaaaaccagttaaacctgaaggagtgggttcctgggatataaacaagctcacaagcgttcatacgctgaatatggatgttactaaccaattaggttatcaaggaacctttttcgtttataatggagatatgtattattccggtatttggaaaaatgggaaagcctcgtatctgttcaacagtggtctaaattataataaattcacaccaatagcaagctccgtgattacaggggatgtgctggcaactggcttaactacagattctttaggaatttgtattgtaggtggaactaaacagttgacacattctgttagcccagaaggaggtaaacttttcaatattaaatacacttcttctgcccctgcaaacatgacaatatcgtctactggtttaatgactttccatgcagaaggtggttttgatgcgggtatgacagccttaaacgctgaaggaacaactttatcagatacctctggaggatatgcttcaacattaagtgtttacactcctagcttatctgcgatggatgtaggaacaacacaaataatggtagcagaaataacgccaacaggggcagcaagcttacctggtatggttgttgagtatacaactacagatcctaatgttgctacagtagatcctacaactggtgtaataactggtgttggtgatggtggttgtagaattggttgcacagctacgtatcaaggtgttgttaccgcttctgatagttcttatttaacggtgaacgctgttgcgggaaaggagttagctccatctccgagtagtagcttaacggttctaaacggatatttcaaccactcggcagatggggcgattacgttcccaactttatcgggtactgttacaccagctaactttgtagttaaggtggatgacgttgtagttccttcaagtaaagtaatatttagaaacaaagctttctctacagtggatagttatccagcaggagaatatagactggctattgaatttgcaagtgcttcggtagttaatagtgtggaagtgtctatggaagcaaacccaagtcttttagaattatggggcggcaacaggattagttattctacaagcccagcctcacaattcttaaaaggttgtgctaacttaagacgaataacctctgattgtttcagtaacacatcttacaccggaacgtctataagtggtattttctctggctgcacaagtttgacagctatccctgaaggattattcagcgatactttatttccttcgatgacaacaatgtcaagcacgtttgaaggttgtacgtctttaacatctattccttctgatttatttaaaaatttatcaaaagttacaagatattcttacacctttaaagattgcacctctcttgcagaagttccagcaggaatgtttgataatattccaacgaaagtgacctctttaacagctacattccaaggttgtttaggacttacagattttaataagatctttaatgacaacccagggttaactgtttgtggtaaacgtggagcattatcttctttctttagtggatgcacaaatcttacaggaacaggaacaacattaacaaatacattaggcggagtagctaatagttacctattcaggtattgcacaaaactttctgattataacaacattccttccggttataaataagaaaaggagccatttggctcctttcttttataaaaactctttataaatcaataagatcagaacggaatatcatcatcgaagtccatcggaggttcttcttgattacttggagttggttctggttgtggttcaggctttttaacttctttcttctcttctttcttaggttgttctgcggaaccacgaatggcagcagcaactttatcagacagagccagaactttacgagcagaatcaatcagatcttctacagatacagtcttaatggtatggtctttacaagcattgaggatagcgtgaccaacagatgccccaagatcataatcattaatatcaacgccacgagattcagcaatttcagatttcagcgtgacagttgcagattgaacaaccccagcgatatcgaaagcatcgcctttaacaccattacgaatcagttccagtgcaccatttactgcgtgaccagtttccagacctacagtatcacgttttttataggactgtttaggagcagcatcgttggaacctttattgccagaagatttgttagacttctgaacaccatcggtagacaatactgtaatacgagattttttagtattgtagtaagttttaccgcctttattatcaacgcgatcaatatcaatacttacttctacacctttttcaatagtgatccaattatcaccttctttgacttgcaggttttcataaccttctttcagttcaatgtcaccaagagaaatccaaacacctttctcatctggtttagcacctttctctttcagaacaagagaggctcggtgagttgaaacaatcgtttttccttcccaatgaaaagttttaggttcagcgaatttatccagtttaacgtagtctacgataccagttgcataagttacggttttgcctttacgatcagtttcagtattaattacggacattattatctcctctacattacattaattttgcacagaaagagcggagtctttccatatcatcttgctctaacaggtatttacctttacctattccaactccaatttcaccattaggaaaatgaactatttgcactgggaaacctccgagtttaattgtggcagctttgccttcttcgtctataacgtttcggattgtatcttgcagtgaaatgaattctttgtttgtaacagtggtttcaattatttcagatgtttcgacacgagcagttagcttcttgtttccaccttgaataaccaaaatttgaaaataaaaagagttgtcaagacctacaacatttttctcaactagtgttaaactggtataatttccataaacagtttcaacagctatcttagaacgttcagtcattgaatgctatcctatcataaaatgtttaatattgtcaagctttaattaccaaggaatatcatcttcttccaatctggtatctacttgaggtggacgtggaaccttaacctctttcacaaaacgaagatatgggaaacgtgtagcaattttaataacatgtttggcatcttctctaacatctttgtgcaagaagcagatccctgtttccaaggttgtttcaaaatctttagaataataacagtccttcccatcaaatgcagcctggcagatggacagatcgaactcatttagaaaggttgtcattacgcttggttccataatcataaggttgcaaagctgaccatcacgttcaaactcaaaaacgtgtttaagaccagtaacaccttcataattatcagaagcctctttgtttcctagtttacgaatattggttcccattaaagcagatgcaattaatccttgtatttgttcttcagtccgatgtgcaggaagagatgtatagaaatccagatcacgtccagcaatatcaagaatacgccaatcacgaacagcaccgccagccaagacagaattaggatcagcgatctttaatacggtaagaatttctttggcaatattgatttgttttgatttagtcattgatacgctccacagttacttttacaacatcgtccatattaatctcatcccccaagacctcaataacaccttcctcataaagtcgagcacattcttcccacacttcagcttccttcattccacctgcaatcttatttgcaagacctttaataacatcttcattttgttcatcaacaagaattgaaacattaaagctcactaatttacgcattgttttctccttatacttctaaacggaaagtttctttagatacaaaatcgtatccacctttttcaagccagtcattgtaaacctcatcggcttgagactctatcataaaataccgagtggtaacttcgtctccgacaatacgcacaattttatagcaaatcatgataccatttcccattaatcttcctccagatcaatttcattataacaatgtatgcagaaaccatcattgtgcatatgttgttcataggacatatctttaccacaagaccaacaacggatatccccatcgtcccattcacgttcttcttcaccttcaaattcatctggtaggtaaggcataccaaaataatctaaatcgtaactcatatcttctcctataaaggggcagaagccccttataaaacaacatgttagatcaatgacaggatgcccaggaattacccacgtcatatccggcagtaagctgaacgttaagattgtaaaattctccagccttagtaacagctaaagcagcaagctcacctgcccgactataagctgtaaaccatccacctttgggagattcatggatgttagcccaaatttgccctgtctctttttccttattatgcttccattcttcaactttagcaaggcattctttatcaattttcttttgttcttcaggatcgtctactttcttccaacctaatgattcaggtgaaaaccatttgaattctacaaggttacgagaaacttcaagctgggcttcatcgtggtatgcaatcatttgttgcacggagtctttattcttccagtcatctttaaagaagtcaacacttagtccttcttcttcgatcatatcgtcataaataaccattgcacgtttagcacagataaccccaccactttggaacagagagttaagaatcgcgtgagcagaacgagtaggaaccttacgaccgtcaatacccaaaacatattgtttaccagtcttaacccaaaaatcgtttaaacgttctttaagacgcgccaatgggaatgcagcttcccagaaagcatcaaacaccaattgacctgtaaacttatcgctaccaattgttttagcaaccttgtcggcttgtgcaccataggtaataccatacttaacagatttagcaggactacgttcaaatttacgtccaatagtttcagtgatacgttttgccatcattgtgtgaacatcgttaggtttctctaacaacagagcgttacaatattcatgaggctccggttcgtagcgccaacagtttcctgtgatggtaatgcagtctttctgacgcatgacccacgtaccaagttctgtttgtggacaccaaacatcctctacaccccactcttcaatagtcaaactttgaacaggaatgtgagagcggttagccaatgttaccacttttactttctgctcttttgtattgaaagctacagagatattgcctccatgcaccaggtacgaggcagttaaagctgcttcaaaaagttcacctgggttctgcgcccaacgccaaacaggtttttgtttatgttcatgccagtaaccatctgcaatcaagaaaccttccaagaaagctacacgctcggcatgagacatattaactacacgctctacccacggaacatcccatttaccttgttgaacagaagttaaactatttacctgatcttgttccatgttaaatggagcattacaaataatattatctcctgtgcaaagctcggcagttgttctgactttaggcacataagtattccctttactacgggtattaacataccaacggtgatctgctgttgcacggtaagtgtgtgatttccctttaatctcaaacgtcttactatttttatagaagaccttaccttttactttagtccattctttcagacctgtttcagcattgtaccctaaaatctcatccccttccttcaggtcgtgatatcctacccaacctttacgagtcaaagcttgagcatccatcggcacacagtaatgcgactcaatctttgcttccaaagagtcgaagtcataaccgatctggaagtatttaggaacttctacaccaaacaagttacgcatctcccatccaaacaaagatgtgacacgagggatattggctacagatctatgcttcatacgagaggttgcagcatcacatgtagcggctggtgtaggaatacgcccatccgcccttactgcggctaagaaacctttatcgtattcttgatcttcttcatcttcttcccaatcagcaccgccacctaaaatagagttcctacgatgcttatacgttaagtattctacaatctgagtagcataaggaaatttctcacccaaagcttgcaggttaggacagatttctttttcctgacctttggtaaaacatgggttagtcaatactttaagaccgcgacctttaccttttgctatacgctcttgaatcttcctttccaaggtttccggtgtgcactccagatgatcacaacgatcctgacaaaaattagaagatagagtttgctcaacgtaagctcgaatacctttctgaagttcttcctcgctctttttaatcttggtgccagatttaagagttaagtctttatctttatattcagacggtacccaacctaatcctacaagccagtttttaatatgggttgtatcgtttaatgttgcagggatgtgaggatcacataaaggctcatctgctgcaactggcagtttccactctttccccaacataactaaccaccaatctccatccctctcttccaaatgaccatcatgtttcttagcaaaattgatcatatggttagttggctctaagttctttttaatttgcaacttaggtggaataaaagccttaagatagccttttgttgctggtttaggtggcaaaataggctcaacgagtaaacgaagacgctccatttctgcatccaaaaaagcaaggttctcttctgcttgcttcatgttaaaagcaaacccacggtgttcctggcgtgtgataatgtctgctacacgttgttcaagttcaaatggaccttcccatttatcataatcaccccattcttccataaggtagttatatacgctcgtattggctttgttgtcatagatacagtaataaagcatatccgcagcaaaagtcttaaatcgatcttcttctggaatctctttacggaaatctatttttacatcaccacctgcttttcgagaaagtgctgccaagctatgtcctgatttgccctcaatctttcgatctgggtttaacactttactcaaaatcaaggagtcaataagttttaccttatttttgccccacgtattatatttaacactgtaatctaatccataaaacagttttgtagccaaccagtcgtagttgataccgttgtgagccacagccatttcaaccagatattcaggcttctctttaaaataaccttcatgattaataaagtctgggaaatcttttagttgaaaatgcgtgtaatcttgcgccacatactctttaagaacatatgtgtatttaccatctgactcttcataaggacgcccatcaaagatgtatttagggccatcgtggaaagctactatttctcctgtttcatggttctctaagacaatacagtgcatttgaaatgtgtctttgagacgataaggactagctaaataatcaatagtgtcattattcaacaatccgtttgcttcaatatcccatgtaaacttactcactattcctcctttctaatgttctccagaacccactgaagttcttttaaacttaaacttcttactcccgcagttttactagcttcagctttaagtaacgggtaagcctcaatgatacgcgttttaagatcagaagtcaaggcttttaaaaaataggtagatgcttcagataaagaatcttcttctgataacactttacctgcacttgctcccgctctcctaacggctatatcgtagtctttactgttacctaatacgaatagttgattctctcctaaaacaacgggagaacgcttctcgttgcgtttaatccatatctggaatacacaaggaacatcccaaggttctccatgaagaataaaagatccttttggacattcttcttcgtaaagaagatgcatgtggggatttagtttgtgtgcaaaaaagattttttgaaatgtgcgaggcaagataaaacaaataccaccttcgttatccaacatttcagcacaatggttaaagaacttaatggcaagactagcattttttccaaatggaggattaccgacaaaagcagttacactaccaacagactcaacagattgagctaaaaaatctgcctcaatacaatcttcaaacttagggtcaatatcaaaagaagttatgtttttaaaacaagaagagaaagctccttctcccgcagatggttctacgtagttagcttcctctccaaaaatttctttgatcttatcacataagaaccccgcataagcggggttagtgtaatattgatcaagtgtgttcaacttgctcaatagtcctccttagttgttagcgaactcaatagtgaggtcaactttaccatcatcagaaataaccatgtttttggtatttttaaagatgatatctactttaccttcgcttacacgacagaatgcaacaccatctgcaactttatcaatataatatttgtaagaaagaatacccactttactacgaccagcaccttttgtgaaagaagggcttacatcgaaacggaaacctttagaagaaacaacacggtaagaacgtccagttggaagatgttcaataacagagacattgttctcaacaacttttacagcaaactcttcaggatgatcctcaacaatcatatgtgggatggcaaatgccaacgcttgtttgtgtttaataacaccagcacccagagcaccagcagctttaacttttgcattcagatcgattgtcatacgcatttttacttctcctcttgtttggttgatgagacaagtataagtcccttccgcaaagttgtcaacaggtatttttaataaaagggccgaagcccttagtagttgctatccgtaggtaagttagcagggttgttaaaatactgctctttgtcgtgaagagttgcagttctaatgtcatagtaaaactgccctgctggaccagtcttggataaagcaatgagttgtattacgttctacaggatcttcagcagccttatctcgttccaaagccaaggtaataccagcacctttagccaagaaactactacccattgcatcgtcctctgttaagtgctcattgccaccattagctgacttcttaacgtgtgagatgacgataatagttatagcatactctttcatgattcgcttcaaccatgttgctaactcttcctgggcttgaacatccataccagaaagcaaatcagaataagggtcgataacaagaattgttactccaaaatagatgatcatctccaaaactttttctttgatagactccacatctgctccacgatcatcacacacgtaaaaacgtggtgatccatcttctctttcgtaaaaatctaggattttttctttattctcttccaagatttgaaatttctcttccggtgttttcctgtgtagaggaatgtgtaggaaagaggataacaggttacgagaatactttttataagtcgcttccaaggacagaatacctagggtatgttctgggtgtgcaacaataatatgtttggtgatctcgttcaccatcaaagttttaccgatactggtctttgccaggatgactgtaatctcttcctctactaaaccaccacccaacatgtttgcagcaacacgcataaaaggaggcaaggtaatcatcttggattccaagcattccaatgcagcttcatacaagacattagaagcataaacacctgctggggtgtatagacgagcactccaaaaagcttttacgaaatcttttgcacggccttcttccagatactgattggcatccttaagatccatctgcatacggtagactttgttacgaggtagcaccttaacaatattttcaaatgcctcattacctgctttgtcgttatccatgcaaacaataatcttcttaaatttttcaaagaaaggatattgtgcctgaacttgtttatacatactggtttcaccagttgtgccacttactacggctggaagctcatatttactgtccaagttttcagatagcatttgataagctgccagagcatcgtgttcaccacctgtaattacaacagtatgagaacggtctgcaaaacgaatttgtccaaaaagatctacatctttacctacttgaccaataggtttactgaaatctttaggatgaatacgacgcttaaaaccaaccaattctttaccgatggtagtcggatataaacaactttctactaccatctgatctccttcctgacggtattcataacgaacaccatagaaagatgaaactttttctttaatgcctcgataaccacgtgggttggttgatgtttcttgaacaattttacgatgaatctgtttattaaattccgaacccacaatctcctcctcttcttctaaaacttcaccattttctcgtaaccattctacgctaggaatagtgtattcacacgcaaagcacttagcacctttatgctctccattagaatctaatccataaaccatcaggttattacgagagcgatccttgccatttttcatgcagcgcggacaacctgtatgcccttccttgctaagatcaacatcaaatccatatttagttataatgtgcgacactttgttctcctgttaaaatggttcgttagtctccatcatatattctgcttctagttcttccatgtgctttctaaattggaaagcaatttctgctacagttacatttaaatctttttcaaaaacttctgtagatccttcataaaaacgaataccgtcaattaaaagccctccgtggtaatcccaatcactttcacgagaaagcggattaggttcttcataatagtaatccacctccacaaccaaggctttcccgttacgagtggtgtattcaaaatcaaaagtgttaatcattatagctcctcaaataaaagtctacgacgctcattcaacacatcaatgtgataatgagtcctgacatacttagctaatgctaatcctttctccatgcaaacatcgggagcacttaataagtattccgtaatatctttccactcggaaggtgtttcagcaaagaataacaaatctttaaactcttgtgtatgataattctcacgaggagagcagattaaaggtaaacccttagcacctgcctcaagaattttaagattgctttttgcattattaaacacgttatcgatcaatggtgcaagactgatttgatgaccatcgtaagattccatgtagttggcatatggtcttacaccttcataaacacaagttggtgctacattttccctgattaaagaccattcacgactacttaaaacttcagaatccctacgaaaaccacatattgtaagatctttaccaaaatcgggcaagatagccaaatcttgtttatgtgtttcacttccagcccagactaatggagttttggagtagcgatcacgggtcaacacaaattgaccttcatcgtaaggaagtccattagggattatgtgcacattatcattgtattgtgaaagttcaacttgcaaggcaggtgtcgtagttgtaacaagatcactgtgctctaaaaaccattttaaatgttcacgaatacctgattcaaaaataccttctaacatgtgtccttttggaataactaaagagtcatccaaatccataaccattttaaagcccaggtttttaagggctaaaaagccctctttaccttttgttggcactccgttaaaaacgaaaacgttgtgtttaggttgtgaagagaactgccttgagtaaggcagcactaccctatggaaatcgcagacactataattgattccgttacgattgtcaagaattatttgtcccatacttcacctacaaactttcaataacctggcgtcgcaattcgtttgcatctgccagattataatgtgttcgaacatgttccgctaagaacaagccgcgatcttcccgatagttcggattgcgaagaagcttaacaatttcgtaatgccattctgctttattctctgcgtaagcaacagcgcgagcatctacagggttaaaataaggtaataccttagaacaaacaatcggaataccttttgccccagcttcaaggattttgagattacttttacaattattaaaatcattatctaccaaaggagctatagcaatagcatgactttcgtaaacactcatgtaattatctaaatcttttacagcagctttatatttggcgtttggtaaatttctacggatcttaatccactcttgccctgtgatactctgcgatgcttcatatcctgcaatagtaagaagttcatcatcgaaagtattagagactagtcgtaaatcgggttcgtgactagcaccgccagcccatacaacaggggtaccggatgaacgatcatttgacaaagtgaattgtccgctatcaaaaggaagtgcatttcggatcacaacaacattcctatttaagtgacggatcttatatgccaaatattccgtagtcacaatgaccacatcggcaagcttaaccatagctacaatagcatgagtgtttgactcatataaacttgctaaataatgttctggattaagttggtagaaatcatctaaatctacaacaatcttaacaccttgacgtttcagggacagaacatattctgcccctttagaatgaatacggttaaacacgacaacatctttcttaggctgaaaattattgttgttaaatggtataacaatacgatgataatcacaaccactgtgaggttttgcatcaattttcagtttagtccattttttatttgacatgtgccagtgcctcctcataagaaattcggattttcccatttttaatatcttctaaagacgctttatattcttcccagttaatgccaatagcaacttctttctcttcttttgtcagattagcaaaaggcataggattgtttccaaaaacatcgtctgggtggatataagccatgatacgaagtggacaaggtattgcctgaataccctgattcaaaccagcagctttcaaacggtgtacccattcagcatcttcaaaaccatagccgtgagtgtaagggcggaaataacccatcttctcaacaacggcacgagaatacattgcaaattgacacattgcaagttcccagagaataacttctcctttactcccaacaactttatctttgaaatactccggcataccaaagaaatcccatcctccagagacagcttgatctacaaaatatgtttcccatccctccatgattgggtagcaatcgtcgtcaaaaataaaccaataatcataaccttcttcataaaactggtgcataagttcattcctggcgtaagctacacctttacgatctggatcgttgaatactcgaaaatctgcatgtggatctgttacaaggtagtctttaagtggacggacacctacagtgataacacccactccgattttaatattttccattttctctcctaaatagttttactgtgatcgtgacagtgtaataaatgatgtatagaccgttgaggatctgtttgacctaatctgtaaatgtgaaacagatacattccccgcatcaatcctaacctctttcctttttcatgtaaagtgcgagagaaaattaagtcgaattggatagatttttcttcgaaaggaatttcattccacaatgattttctaaaaagcaaaaagaaacctgccagaggtgttccgaaaggaacttcttcaacactcactttatgatattctcttgcaatcttagcatattctatatggtttagaatatctggatcatcgttaatttggttagagaaaagctgataaccactacctaacctgttacaagttgcacctattacatcaaaaggtgggtttgacataacaaactcttcaagcatagatggttgatcaggcaggaggaacatcgtatcggtatctcttaaacacacccaactatcatctggaagaacggcaatagcttcattgatagccttgccgatatttcctgtcagatagggagtaatataataaatcattctcccctccgttatattaactgtcggctacaatcccgcgtttaatcatttcctgttggatttggatgacacgatctcgtgcttccatgtattctttaaaagattcttgaagatggtcacgagctacgtctcgtagcttaatcagtttgtcgtttgtcacttcttgaagagagatttcgccagtttcattggtcccaagcgttttcatttacaacctccttaatagctactgcacagttcttacaaatacattgacctttgttcttagaaatttcaatgtaaggttcattttcgttttctccgcgtcgtgagtcgtatattactgtattgaagcagacaacgcaaatgtttttaataacgacatatttttgcactttctgtttagtgcgaaaattgacttcaatgacttctcccatcaatgaatctcccctaaaatgttgttttgagacattactgcggagcattctacagcatcatgagtccttgcaaaacgctcccacaacacagcatctactttaagaaccatacaaggataaatactgtcgttgatcatgtcaatgctatatttatctacatccttttcatcttccataaacaaagtagcgtatgcttctaaatgcttacgggtgtagtatacatcctcttcagtaagaccgacaaccaggtaacttgctacaacaacagtattatcttcttgcattttaactcccctttggtagatagaaaccatgcactttatctcgataaacaagacgcatatcacgttcccagtgtgtccttatattccgtttcttgaaatatagagcacctttagtaacatctaaaacagaccgcaattcaggaaaatgtttctctaaataaagtaaacgctccgctattgcttttgcttcctgccacttatctttctctgttacgttaaaagttttcgcatatgagaattgccctttctggaacaagactcctctgactgtgttagggaagtaggtatcatttcttctgttgattaccacattcccaacggcattcattccttttttacccagaccgcgaccttctgcgtaaattgcacaagctaatagaattttatcattatattgctttgtacatttgtgaactactttagcggtttttacgtttgcagcttcggctttcgccacaacaggtgtaaatgtaaaagcagttaaggatagtaacgcaactgttacaaagttttttatcagcaaattttgcctcctttttaagttaacgaatttctagtataacacgatagaggctttattgcaagagggggatttctccccctcaaaatcatttgttagttattatggacattcataccattcttttttaccaccgaaggccatcaccacatcacaaatatccagaccagctttacctacaccatatgctttcagcttccattccccatcttcacgaaccaaggaagccacgtggcagattgtgttgccagctacttcaggagccaggaagtcaaaatccagaatttccacattgcgctcggagtcgaagattttaagcataccttcagaagcatgaccaaaacgtttcagacctgtatcatcatcaatggtcagaacaaaggcaatctcttgtgcatcaggagagattttagccagagtaatatcaatctgctccatgctgccagttccatcacgaacatcgtcaccagcgaaggtagaacgttcaggatcaaacttgttagcatagcaaactagatgacgtgcagacagcatttcaggattgccagcggcattatgacgacaaaccagtgcacttacatccagatccagtttagaatcagatttccaagagaattctaggcgcagttctttcagagccggagcaactttcttcagggaaattttttcgctagagccttttttcagggaaattttatcagtcatcttttgtctcctctattatttaagtgtaataccagttacagtcaattctacttccaaaagcttagatgtgttttggattgatactaattgtgcatgatggtttagttctacagcagaataatcattttccccatcatctacttttaaataaacaatgatttcactaaggtctaaaccattttcgtcaaatgcattttcatagacgaaagtatctcctacatccaaatctttaatggtaaggcatcgtttatttactttttgctcatcaatttcgaagtttaacacttcttcctcctaatgttatctccggtttgtatatacgaagaattatagcattttcattttctttgtcaacccattcttcataatcaggccatacatgaatctctactctacttacaatatcttccattcgcacagtcccaatgaaatactctttgagactgcgcataatgaaagcttctctctcgcgccaataattttctatgacttgagaggcaagctcgtcgatcattttttagcacctactttaacaacccactctccgaactcttcagataagagtttgtcataaagctctgaatctgtcaagtctaaatctttaataccaataaaaccaacattatcataagcatttgccagttctttcaggaagccaaacttctcattaccaacgccaaccatgaaccaataaataggtttattcttattctcttcgataagacgacgaacagcactaggatcaccattctcaccatccgtttggaagaatacaacaccaggggtaacgtcagcacctggttcagatacagctacaaccttttcacgctctacagatactgtttcagttttaccaagtagacgattaaagaaacctttctttggagcctcctcttgtaccacttgtttagtggtaatatatttggtaacagtgccaaaatactcatcgtagatatctgccattacaggggcgtaatttgttccacctccgatacgaacattacgcatacatttaccaacatagtcatcgtaaacgtctgctgttgctggagtaagctcttgggaactcgtattgaaggcccacatatcaatttgttgattatcgtcgaacagcataccaaaaggaagcagtttacctacaaaatcactcactaccccactagaatatagaccatgcatactaccagaaatatctagagcacatgctacacgaagaacaatcttaccttcattcaggttcttattctttttcagagagaaagcaaggttttcttgacgttttttcaggctgattttctcggacatattatttctccttcttaagtgtaatattggtaacttctaaatctacttccaccatatttgtatctggtgggatgcaatgagtatagcctcgttgtgctagtgatccattaatacaaatcgcactgtttgtggaatttttaatgaacaccaagttacggtaggtatccaaccctgcgtcttcataggcatcataatacatgaatgttgcccctacgtcaagatcttcgaaagcaataggtaaatcttgacttttttcttcttgaatattgaatctaaacacgcatacctcctctaccaattttgaagcccaaatcgtaagcttccttagtgatcttttgtaactcacttgtaggaagtgttacaagaggatcatcttcttcaatttccatcttgtcatcttctgtttcaatgagagtattatgcactttgtgataagggttgtcaacacgtttaaacttattcttttctgtgctgaaaaaacaatctggatcttcttcaccatcaccccaaccttggttaggatctccgtcagattgttctgtagggatttcacctgtaaagtactcttccagcaccatagcgataccgtcccttggatttgaggaatgcatcaaatcacaaaccttactccaatccatagcccattcaaatcgttcacgaacaccattttcatcctcctttccagagaaaacacaaccataactatcatagttgccatacatctcttcaataacaacaccgtccttcaaaagaaagaggtagcaaggtgatccgtcgaaagaagtagaaagggcagctttgcccgattctttgcacaaaaagctaaaacaacccattacaaaccctccttcagattatcaagagctacagtggtttcacaaaattctccataagctttatgatgttccagaaaagcttcgggtccaccccagtcattatcttgtgtattccagccatcaataaaagcatcttcaatgattgtgatcagttcctgtcgagtcaacgtaatggtatcaggtttctgcgtagtttccacacggaaccctggttcttcataaaaacctttagttacaatggattctaactcttctgcatcacagaggaagtagccacaaagataacaccaaccgtcatcatctttcattacttcataaacttcaccacttgctaacttagtgaaaagagtagggtctgttactgtaagttttaaaagaatacctgttggattatacatcttcttcctcctctaaaatatggaacccgtaattacaataatcctgaaaggtttcgtgtgcaagatcttctatatcctcttgagacatatcatcttcaatttcgatatccacaacctcattgcatccacaccaagcagtttcaatattcactcgtaatattttcattactcctcctcctcattgaagtcaatatctgcaaggagttcgaatttacggaagttacgacaaccttcataaatataacaatcacgacaaactgctagaacacttgggggatatatacctcccatcggtgcgaatcgtttttcgtcatcataacggacaccaatgtcttcatcaattatatagatacggattctcatttaccaagccctcgtttcacagcagctaccatcccgtcttccagagattgaacttcattaatataatcaacacgagcagcacgggcttccgtattgatgcggttagtttcttccaacatcttaaccaagttttcctgatcgtgacgcagagtttcaatatccaacacttgacggttagccagtgctgctgcttcgatctgattctgtgtggcaagatcgctacccagtttaattgccaggttaaattcatcaagaacgttattctgcgtctctgctgctttcatttgacgtaagctctcgatatacattgagaagttagcagagtaagcaggaataacattatttactatgttacgcgcagatcgcattaagcttgcagaaactttttgcataccttgtacacgcggtcccatttggacacacagtaggcgcaatgcttttaaatctgcaatacgaatctccagaagatccaaagtatctcggatcacttgtcgctgttctactgcatcttctggaagagcagccaaagcttgttcttctttttcataggttgctgttagaagctgcatatctcggttcaaacttgcagcatattgtccaatagcttgatgtagcttttcaagatataccaaggaatcttcttctttgcgaatatccatttgaaggttctttaccaactcttcaatacggttattaacattatcaaactccccaaacaggtcttctttcatacccataacttttttaatgagtttagtaatacccttgctttgtttaatagagtttggatcaagttgttttgcctgtttaatcaaagctgtgagtcgttcactcatctgatcgccttgattactacgttgatgttttaatacctcggcatttaaggaacgcaaggttgttcctgcctctgccccaatctcttcgatctcttgtcgggtcatagaaggcaaaaccggaacttcttgcggtgcggctggtgcataaacaggactggcatctaacacgcttggagcgaatacagatttacttgcatctgttgttgcagcaaatacgctcatttcaggcttcttctgaccgccagtagctgcttttaaaaatggacttgtcattcttcattctcctcttctgcatctcttatatatggtgaaacaccgtactctttagctactttaacccaatcgtcccatttatacaaccataattttccttcggtcccttctttatctgatttcaaccacatattaggttgcttacctgggtacatgcgattaggtttacgattataacctctaacacatcttgtcgcaaacctatctaccagaacaagaacatatttatattcgtggttcaacggctctttggaagtggctttaggattagcccctaactctgctgccagtttttgccaatgagcaccgtgtctactaaacttacccatacaaccatcaatagcatgagcaatttcgtgcttcattgtatccacgatcatatctcttgtggagttcttatgcaagtgccaatttacaacaacaattttatctcggtagttgcaccaaccgaaagagttattcactttgtttctaacacaagctttatatcctgcttcatgtaacatgttgtagtaaacaggaaaatcttcttttatttcctgcatcacttcccaccacaagagttgcaagtctctctcggtatgcataacttacaccttaaaagcgaaatgcgtggtcgtggcttcaaaatcagggccagataaacttgcactgaaatctgaaatatttgtaattaaaaagcttttatgcatacctaacacagccacgctttcaatatcttctactaacatttcaatcatgttagaaacatggctgaacgtagagttttgttttttgatggtgtagaaagaaagattcccacctgctgtataagatacctcttcaaaatctttaatcgtatattgtgtgccatcagtaaagaaaatggtagctttattagtagcacgtttcttgttttttggtccttttttacgtttactgcgagtaggcaaaccgtttgggaacaccatagctacaaattcttcagcagaaacctccttaccgaaatcataaccataagaaacagcgtctataaactcgtcatcttcatttttaaaataatggaaatagggccaatttgaaagattatcaagcatcttatgctcgtccacagcagagaatgtatccctcaaagcgcgtgtgatttgcaaagcattaggcaaccttttaacacctacgatggaagtacgaatagaaattgtcattgtttttctccttattaacgtcgcttgctacgagatgaactctttttacttaaagggctattgtaagatttacgagttgtatagctactatttgttttaaaagtttgtctcggcttttcataagtttttatctcttgtttaggcttaccataaaaattagttttcggtttaggtgtattataatgcttattaataatcgttctgttatcgttataatccccactgctacgattactaccgccactcatcatatgccctaacaacatacctgtagcaaactcaccaacaccgctactactagaaccgccaccattgttgataatagttgtatctccgtcagatccttgttgagcgtattgttgaggaggttgttggtattgtgcaggatttgtttcatcctcgcaagctgttaaaaagatacaaccaattaaaatcagggctagttttttcatatttgctttcctcgttttggctattaatacatctgtgtttgaaatctccagagaagcaataaagttgctctccatctcggtataaactcactttactgccgttgattacgcttgtcaatacaaaaattacaacaaacaaccctattgcaaaacaaatattttcaaacacaaccaacaagtatttcattttaaaaatacctcatcatcagtttcattatcccagaagaacaaatcccaaccattcggatcattccatttggctgctggagaagtccatatttgttcgatatcaatattcaaaacttcaccgtttcgttttgaaacagctttagttaattcccaacgagatacaggctctacttcccctgaaccactcccacaacaagctaccacgttaggaggcaaattaattggatctttggtcacaatcataacgcttaccccagggtaaacttttgaaagataatctgaaacgtaatcaacatccccaggtaaatcccaaacaagtttttgaatttcatcaaaattactcataagtctctcctataaaatagcctcccgaaggaggctcatctattaaacagtagcttcttctttttcagggaagataaagcttgcaataacaccaagagctaatgtgcccagaacaatcatcagacttacgttaggggaaatatcatgcgggaggaatgaccacttggcatgaagtgtttcaccgaacggatgatacataagtttagcaccaacaaacaccagaaccacagcaacagctttctctaagtgaaccaaatatttcacagctacacttaacacaaagaaaagtgcacgtaaaccaagaacagccatcagcattgcagaataaactaacagaggttcttgtgtcacaccgatcacagccggaactgaatcaaaagagaagacaatatctgtaagctcaataacaaacacacaaagaagagcaggagttgcatatttaataccattcttaatggtgatgaacttttcaccatccagtgcattgtgcacaggcagaactttacctactaaacgaacagcccaatgcttagagtaatcaatatcctcttcttcgtcaccgcctttgatgatagccacggcagaccaagctacaatcaaaccgaacaacacttggaccgaccaatgcaggttaaacaaagctgttcctgctgcaacaaaaatacctcggaagacaatggctcctgcaatcccccaaagtaaaatcttatgttggagatgtgtgctcttaattccaaagcttgcaaaaattgccatgaacaccattaggttatctacagaaagactcttttccaacacatagccacttaggaaaagcgcggcaaactctttaccatgttctacccaaatgaatgcgtaatatcctaaagctaaagcaatccaaaaaacagaccaaagcaaagcagatttaattccaatttctttattctctttatgaccaaagaaatcgataccaatagacaatgctaaaataccaactaaaacaactacatcaatgattgggaaaccaagttgcattattttctcctttctctttgcggggaaccactccccgcctcatgtgatacatcttactcttttttaaaaccttgtcaacacttattttgaagaactggaggaaaagattccacgcagcactgccataatgaacgctacgcacaccacggtccagaatgtaacaggaacagtgatatctgtgtgacccatcatttcaacaacgtagttgtaagccagcagcagaagccacgctggaatcatactgatcaggaaagccagaacaaacacgataactactgccagaacacctgcaacaacacccatattatttctcctcttaaagtttataaatagtcacatcgtgacctgcttttactaaagtttcttcaatcatcacttcgatgatagcccaattacctcctgccaaccctgctccaatcataggtaaaccaatcttatgttcggcagatgtgttcacccatttgtggagatcctttgccatagcctcaagagcatcatacagggcatcatagtccaactgacgacctttaccgttatacccgtaacggtactgtccgtataggttataaaccagtgggtcagacacctcctccggcacccctaaactaaaagaacccagcttactttgatcacctgcggctgtgtccaagtcggctgcatatgcataaggaaatgctcgtttaatttgcggagcaatccctgcacccatattacacatacagttacaacagtgggctataacgttcacttccccattcttcgctgcatcgatcagattcccagtaacaaccttcaacatttttcctccttacagaatatgttgttttgtgtaacgatccaagaactcaaagttttcagcatactttgcaattcgattgtagccttcagctaaacagccgaagaaaagttgttccacatagtagtgtggcaattggctaagaatgattttgaagtcttcgtgattttggcccataagatacttaataggacgaacaaggcactgtgcatcacgttcttcattaatcattttaacaaacgcttctggtgtattaatataattaaaattcagtttagcttcggtatctgcttgattaccttcatattttgcaaaatacaagaagtaaacatcatttttaacttgattttcatcaaggatctcaatcagtttgtcttcatgagttccagtgatatttacatcatcaataaacacaagcttcttatcaccccagaattctttgttgcagtagaatgtatccccatcaataagtttcttacgactagctttatccaagaaaccataatcgttgatatagctaactttacgatgaataatatccagttctgctgaacgaccttgatcatattgtgcttgcaacatattaaagtaattaataaaatgatctgtcatcattgttgcagcattatgcacatggttgtaaggagaagggatgataacaaattgttccccaatatgtttcattgccacttgagcaaaaaactgaagtgccaattctttacccatacgacgcgcagcttggttactaccaaatttcaattttgaatagtctttgatatcaaaagtagcagtttccaggtcatcaaatttatttgcaaaaatttgagtttgattacgcatttacaatttctcctcttttaagtttctctagtaagtcgttagggttcttaatatgacagaagttaatccctatgtcaacacatttaccatcaaattcttcgctgtccccaacatgtaaaatctcttcagccttcaaaggaatgcttgaatatgtggcggtcctaacaaaaaatctaggatctggtttacataacagatgttcgtctgaaaaatgcataaattcaaaacaattccaactgtcgaacatacaagcacgacgcaaaatatccccagatataaaattagtattgcttttaatactaagatcatatttaccagacaagtatagcaaacaaactggcaaatctaaagcgatatgtggaggaaatttaagaaaccattgctcacactcaaaacgcatttgtgcagattctacaggggttaaacctatctttcttcccaacatattccatgcatatgctacaccttctgcacacccatttagtgcagcattatccataatttctttggcatctttatatgcttcttttgccgcacgttcagacattctaccatatgtagcaatagtgtgcgtacgtgcatctgcatagttttgattggcagaaataagagtattccatacatcaaaagagatatgttttattgtcatactaggcccaccacgcatcaagatttaagttactgtctaccacaacttgttctatgtggtagccttttatctgtatcccactgttcaagagcatatcatacgcttcattgaaacgcaacttatcttctgcggaatataagcgagcattataaaatcggtaatcaatttcttcagcattagaagaaatacggaagaagtttgtttctacttcgggatcacttgctgaagtcttaatgtgaacttctccataattttctttacttagatccatgaaaagaacacaggcaacatgtttaaacattcgttccagtttgtaacgaacaacattgaaacctgcattctcaagtttttctacacactgcaacattaaagtagtgtcgagatcgctttgatactttgttaacatacgatcacgttgagactttgtatcccgatgtaaatcaattgttgtgcatttggcaccaataatcttagctgctttcatcaactcttcagaactaacgttagataaagtaagatgaaaatgggctttccacacttttttagcaggaacaccaaaagatttatccccactattcggcatgttgactactacactatgttgcattacttatctcctcacttaaaatggaagtctttgaagttcatctcctccgatatcaagtaatttagcaacatctcgatcagaaagcaactcttttctttgtaaaatatccacaagggttgcaagaatgtccttaacgtcccgatcactgttcttcaaaagttctcctgccgtccctactttatcccctacagcaaaatatgtaaccatgaaacctcctaagttaatctgattgccaaccacttgccgttttggtccataatctttgattatctgaccctctgaaaggttttgtagttggattgtttatttcatactttccgtctacaataatgtcaacaagatttttaatatacaaaggcacttcctcaaaagtatatcctgtatacaccattatatctttgcttgacccataaacgtctctaaccttttctataaggtttttaacattgtaaatattctgcggatctaatggctctcctcctaaaattgttaaaccttttacaaacggtcttgacaaatcttttaaaacttgctctacattttcgtgagtgaacggtttcccataagaataagaccaggctttttggttaaaacagccacgacaaccgtggctacaaccactaacccagagggagcacctaactccctcaccattaataagatctacaggttcatatcctgcaaaattcaaagatgtttctccctttgcaaaacttcctgcattttacctttgttgtaaggccgtgaattaggggcagaaagataccctgatacacgtctaactacagaaatagtttcttcttcatggttgccacaatcaggacactcaaaccctttagccgttgccttaaattctccatgaaaaccacacttaaagcattgatccacgggctgattaataccaaaatagtgaatatgttcataagcgtagtctactaaagtctccaaagcttctaagttattctttaagtttggtgtttcgacataacttatgttaccaccattgctaatctgtgcaaaacctgcttcataatcccatttttcaaaaggatttgttaccaaccatacaggttggtgaaaagagttggtaagatagtctctttctaccaaacctgggtatttttcatttaaagctgttgcaaacttatagcacaaggattctgctggagttccatagagactaaacgccagcttagatcgttctttaaacacagcacacacatctttcatatgttgcagaatgcttttaccaagttcctttttatctttttcttctggataaaggatttccaaagcttcggcaagacctacataaccaatactaatagaagcatagccaccttcaaacaaaacaccaatttcatcattggcatttaaacgcgctaaagccccttccatgaaaagaatagggttttcagatgctttggtatgcctaatacggtttacacgtaacatgtgagcatcgtaggctatctccatatgtttattaaggaggtcggtgaaagattctcctttacttctcgcttccgcagcaatcagaggtaaattgatagaaactactccaaggttgaatcgtccatcatatttttctccttgttcggtggcatagtacgacaaaaaggaacgacaacccatactcgtaacagtaccatctgctgatcccgtaacttctttgttcaaaggaacagaaataaaatctggataaatacgatcagcacaacatgccaaagcttgttgcttaagatcatagttaggatcactaggtttcatgttaacaccttcttgtaaaaagaaaataactttagggaatacaggtgttacatgatctttgcctagaccgttactatgcactttaagatagttagctgtgatcattctgccaaaaacagaggtatccagacccatactgattgtaataaaaggagattgtccattaacactcattaaagtattaacctgatacaagagagtttgcatagcatcatatacatcttgttcggtcatttctagggcttctttccttgcataacaaccgtagcgacgtttggttatctccatgtttttaaggaaactagcttcaacataaggactaagacctttatcaatgtgcgcacacgtctgacctccatactgactggaggcaacagcttggatgatttgagttagcactgtagtagctaccccaatagattttggtttttctatctgtgcggctccgatcttaaaaccattctctaacatatcttgataattaacaagacaacagtttgtaagaggagagagtagataatccaagtcgtgaatatgtccaaaaccttctgtatgccattctgacaagttttttggcagtatctgtgtcattgccatatgtttgcttaaaatccccgccaagagatccctgtgcgtgttaacgaggtgggaaggtttgtttgcattctctctagtgtatgtttctgaagtgcgatctaaaaaagaaaaaacatcttggtacaaatctttcattattaatccttattttgtgagtagaactattattctacctcttccaaccgaaaaaagctttgaggaaaatcaaaaaaggcgcaaagtgcgcctttaagttttatcatttggagaggaattgtcttcccatgatcttaccgttcttcacagcggtcccatcgtgtccattgtaatcccaagttccatcgatattacgcaagaagctatcacgaacagcataggctttaccgttctctactttactttcttccacaatgattgccataacaagcttattttcaatttcggtagtaaccgattctttgataccctctgtaacttcacgatcatattggatataaactcgctcctcggttacttgcacgtctaccacatttttaaatgtgtaggtctgttgcgtagtgtagaggacacgaacgacactcttcttacctaccggaggcttcttacgaggcttacggtaacgtggtttagggttgttagttggaagccaaccaacaatatcccgatcatatccaacatgaccccaagtgaaatgcgtagccgatccactatccgtagttccgtcacgaaagagaacttctacgtgaccaccacaagggcggtgtccaccattattatagttgtattttgccgtgcgcgggagaatgaagtattctttaatcgcccactcttccagattgtcgatattccaagtgaatactgttcccttagcaacatctgtttgaccattgttgaagcgaacctgcacgaaatcttctgaaggcataacacctgtattcggcagatattcaaatgcagtatcttccgctacaaactgttcttcctcttgctcctcaatacttggcacaggcgcagcttcatcgtatttcgcagcaaacatatttttaaattcttgagccgtgacttctacaaagccgcgatcaccagtagcagcagagtgtgggcgtggtaaatccccaacttcaatatgcattgcatctaagcctgcttgacgatcaaagaagataaccttgcggaattgtttatctttatattgtggcagttcatacatacttggatcgattgtcttcaaacgttcagcatcttctggcttccagaagcttttacctgttgcaaatctaaagtctaccagtagtttaacaacatctcctaatgataaactatctgcatctacgaaaacgtcttcgattcccaataaccctgatttcttaagaatcagatctaacatgtaacctcctgtggtttgttctgcgtctggataacgatcaacactggtgctggttacaccgtttatttcaccagtggaggcattgtaggaaatatatgggaaggtcatatcgttcattgcaaaatcacctgaacaggttggatcatcttctccctcccagccatacaccttcacaataccttcacacaatttgtcatacacaccagcgcgacgtgctgcttcagcaacttcctgtttacgggcaaatttattaatcatgattcctcctgttaattgccatagatgcacgaggttcggctatggctgttgcataaatatatggatgaccttgtggggacaatcttgttccgaatgaccctaattctaaaccattcatgtcttccacgtcaagccctatttctgtttctacaattcttgtttggactttgtagtaggtccagaagaagtatcgcatttcttcggcatactctttcacttcaccaaagctgggatagaactcaatcaactccagcttcaagaagatgttgaagtgagaatcatccaacacttcctctgtgcggtaacatggtgtcagggccatgtagggatgaccagcgataaactcgtagccatccttttccatttgcaagaatgattgctcggcactggcaacataaaacttcccattaggatgccccaaaggagcatcttctttgccaggtggcagtgtgaatgccaaaatatctgcatctactaaataaggaacatctaacatttcagcaaagcgtccataactctggatggcttcggcaatcacacctgtgttcatgaccttcctcctgtgcggaaagcgcgtttagtaatgttggacataatgattaaatcttgtaaagtcatatctgggaactgttgttctaaaactccctcgacagcccctataatatctgacaattcaacaagttgcattattttgcaatcctgctcaacagcatcaaaaagttcttctacttcctctttaatcttttctatgctgccataaggttgtttcttaatgtctgttatgtgataccctgccatttaacgatcctctctgatttgattaatcttacgagcaagggcagctataagcttatcttcttcagatacaggagccgtgctcttacctaaacgatgcatgtctaaaatctcttgaacagtccggttccattgcagacatttaatacaacgtgtatgtgcaacatacagaagatttcgttctgattcttcaagacctacccactcacccttcttatcataattagaaggaaagtcatttgcaacaataacctgatcccattccaaaccttttgatttgtgggctgtagttaaagtaactttagccgttggagagttacggtgcatacgtaaagtgtatgcaatattattagctttaccagaaacaacaatgtttaaaagtcgttttgcatcaggatctgattctgcacactctacaaattcttcccaagaagtgtaaggtagaactgtctcatgcttaactttgtccaaatcacctctacgtaaagcattaacactatcaaccatagaaatgaaatctttggtatctacgttaataataatctcttctccgttagcgattcggtccatagcttcgagcaacagagtcaaattcttacggaaaataatggtgtaaggtttactataatctactacatcagaatgaaaacttccagtgacagtatcataacctttgcctaccagcggatgcttcagaggtgagcgatcagaaaggatcgcattggcaatgtccgcaactttaggaccaaagcgaaaacaagctgtcagaggcaactcaaccccatatgtagccgtttgcttcatcatgttctggcttccacggaactgataaatactctgaaattcatcacccacaacaacaatacgtttagccgatttagcattgcgaaggatagacaggaatgcagggttaacatcctggaattcatctccaaaaataatatcgtatcctaaatcttctttacttaattcaaagagtttcacataggtgtcatgagtcataatggtttctgatttaggatcaatacgctcacgccaaagttgcttcgcatatttaacaacttcattaataagtttttgttcgttgatgttcttacgtttaagatctgacatatgcactttaggaaaatgtttatgtccaatatgttcatcgtcagaaaactcatatttagctaaagtttgttttaccattaacccgatcattgcacgagtcagtagcactttaccattcttatcaatcaaattctgaatcttgaattttttggcaatctcactaccagttccagctacgttaacatattgaccttctggacgagacaatttgtgtcgaaggttttgtggaagacgttggtaacagattgaatgtagcgttcggcacataacgttaggcggcattttacgtcgagcttcctctgccatacttttgttaaacgccaagtatagaatactatcatttgtgccattagccaacatatatagtgttgacgttttacctgatccagatttagcttgaattgtaacgaaacgattttctttatacccgctttcaatagcgtattgttcctcggtaggtgtaaaactcaattgtgtagacacgtatttctcctctcttaataaaaactcttgacaatcctcatcatttccttagctctgctggcataaggttcttttagattaggtggcaaatgtgcattaatgtaccccatttgtttttcccatgtccacttatctttaaatcttggcatggtgtctcctgctaaactgttttcttttcgtgtttgaataatccaattacatggaaaatgcacaccacctttacggaagggaatataatgtcccaatgtgaatgccttattgttctttaaacgtccagctaaattaagattaacaataagactacgaaacacgtagtattgataaagattgtcaacagtatatacagagtagtatgctctaagtgcattatctctactaagattaccaacatccaaactgcaccagtttaaattacttggatcgtagttgtgattatcaatccattcttctctttcctcaaattctgcattaacagcagactgccctgctgtagatacaaaaagagaatttgcatcaaagaacatactcactccccctttagtttacatcgtttagagcattaccaatctttaagataataacatcattaagagcgtcttctccattaaggccagagaaagcaggagtaacgaaagttaccatatagtaatggtcttcttgtaggattgcgataacgccgtctagtttaacatctcctgtgaaacgaaaaactttcaacttttgttctaaaggaagatctccttcaacatttaaaaccatatctccgacaccaaacttttctgccccgatgtagatgtaagcttggtcctcttttttatgataatacagtgttgcttgtttgtcttgtagtgttgtgataccaaacacatctacatcaataatatttttcaaaaaattctcctcttattttgtgttgaccttatttcgcattaacctgtgggatacagagttgcgagatctgtttagaaccttaccaatccctgcatgactatacccttcactatttaacttttcaagaatctggtcttcttcctctgtccagtagcggcgtttagcttgtctatcatccacaccatacatgataggttgctttacatccatcacttttagcaatctgacagcctcttccgctttctcttttttgaaacggagataagggattaaattctcaagcaatcttatcacactttctctgctgctaacattgatattatacatcaaattatcatatttttcagcccaagctacgcgcgatgtgaaagagacagtatatccataactttccaactctttagccaaatcggtcatttcttctgccgatctctcgtgttgtgtaaggtttactgtgtaggagtctgaagtctccctgtttctgcttataatagacccatcacaatctatgcaacctgcgtagtaagcataaaacagttgttcttttatgtccacaatattaacctaaacacatacgtgcgatcagaccttgaattagtttatctgcttcttcccgatcatagtcggtatcttctataccaccatcttcgtcacgataaactttaccttccaggtacccagcatcgatcaaaccaataatcaaatcgaactgccagcaagagttaccgaaagggcgttttccactgaaactatcttcttcttcccaaagtgtagagagcagtcgtctgaaatattcacgcacagtaacagtgccaagatcatcgtcttcaaaaacaacatctaaagcatctggttcagctttctctacaacaggcacataacgttgaccattaataacaacatctacgattgtttctctcatttttcctcctttttgtattcaatgaacatatctgcatagtaagctttacgttcttcaaatttagcagggtttaccacaatgaacaacacctttctattgtcttgtggttctttgactgtaatatataaatcttttgtgcaatagaaacctgtggctttgtaagcgtcaccccaattatccactccacgatctatacgatcaaacttgcagttatactttttatcatccacctggtagacagcttcaccaccataccaagtgaagaattggctaccttccaccccaatcttgaaaccatcacgggcggctgtagcattggtggcaatcatcaacatcaggacacaaagtagccttttcatttagaattcctcttcagtcttctgtcggtttttgaagaatactacgtcatatacctctccgtaaccatcatttacacagaacataataaaacgatcatcttctgctgttggtgcgcgatgttcaagttcaaaactttcaataaaacctcgtgaatttacgtagtagatttcatcctcaccagagaacatccaatccctgtctatcagatagaaagctaaactcacaggcgacaactcatccttcacagaatcattgtacagcatgtgggctgcaactgccaagcttaaagtcggattatacaacattacacctcctcgtcagactcatctgctttagagaatacaacattaaacgtttcaccgcaaccattatttacgaaatacatgataaagttttcatcttcgtctacagggccacggtattccagttcgtagctatacagagaactatcgcttgtggctccctgcggataccagaaatagatctcatcgaaagatttaacccacttcaaacctgtacgatcctcaaacactaatgaggaaggattgtcagcatctttgacagcttcttcataatcctggtggaacttgactgctgttgataatgtgctcattatgcctcctcgtaatgtttgcaaacaacgtgtctccacgtcttcttataatgttctcgcttcgtcatagcttcttgataagagggaatacgctgtaacagaagtctccattcacagtctacgcccatacgtccgtacaaagcataacgaacattgtttttcttgtcttgcatactccctccgatcagttaattaaactttttcccaagtaccaaaagcacaggaagggtagattccaacttgagggtttccgttatcatctttgaaagtaaaactgttgttgtctttatcaagaactgtagaataaatcttaccaacagtaacgcagttggaagcttgacccagttcagtgagagtaagacatttcattttctgtttctttgtagccatttataaaatctccttagtaagtgaatctttattctacacaaagagctttacacatgtcaagtaactctttgtcagattagtcttaatgattggtgatgttgatgacaatcttagtttcaaccttagcccaacaggagtctgcttcattaaaacgactattcacaatgtattctcctgcacgagaacctgttaagcacactgcacctgtatctgtagccaaatagtattcccgttcttgttcatctacttctgcaatgtaatagtagaaaacagacataggttcaatttcagataaacggtataactttggaacaggggatttctcgataaactcaacagaagttttactcatttgttttctcctagatctaaactaattaagaagtcacgaaggatgatcatttgttctgtagacaatgataatacaccttctccataaatatcaccagaccattcagcagttagatctagtgtaccagtaccaggaaaccaatcaacagtgatctgattaccattagagtcaggtagtatttcactgactaacataacacactctcctattattgttcttgatcttacgatcatctaccgataagaacaagtacttaaatctctgttcttcgaacatctaacgatagagattaatctattacataatctatactcgctatcgctcgacccttcgggggttagggtagcatattttttgaaaaaagtcaacacttattttttggtaagtagataaatcaattattcacctgcttctggtgcatatagtgctttagtatcgaagtcaaagaagtgagtgactcctgttactttggatgcatgaatagataatcgtgcaagcttaagcagattatccatttccgcaatctttgcacgaaatactgcacgtgtagcgtcaaaagctgcatgtggcatgtatttacgatttagactactacgtttaaatttacgataatctgcaatgatcctgttacgttctttgttcaagtgcttgaccagtgcagtatatacatgtggttctttgttagccattgttaatctcctcttcatatgttggtagtgcatggtatgcgatcacaggtgccaagtcaaaataaaaatgaccattgataacagctatcgtgccattgcgtgttttgttaacttcacagaatcccttcttgccgtttgccatgattacaagccactctccgataggaacatcctcggtgccagatactttaatccatccactcactttacttcccctttgtaatcggacactataccaggtcttacttttgccttaagatgtttcaactctgccataggagttgccacttgtataaggttaataatttcaacctcgtagatagtatactcataacccgcatacttcccgatggaatgcaggtatttgatagcatgttcaggtgaatctgcttcaacataccccaaatcttttgtagtgcggccttcacagtcgccttctgtagttacgtgataaagtgtcataaaacctcctcatagtaaggtaaagccttgatcagttgttctgaagtgccattttgcacccacgtaacacccttgtcaagagaaacataccctttcttattgataaatttacggagacaaccagtgaacttgtttttgtagatcatttcttctttcctttctttaatttgttgtgacctttacccttataaagcttgtgattacgagcagacgggttattttggttctccagtcggctaacaggtatattccaaaggtttcctgctacaaaagatgctgccacaagttcttccaggtatacaaaatccaaagcaggtatctttgtttccctcatctcgcgttctacattagacaacacgccttcttccttactgtcttctttttcaattacagaccaaccctcttcctgccaagcttcccctctgaaccaagtttccatgttataaccttgttcgtcgagaataacaccatctcgcatctcaaaccattcgccaccacaaaaatggcggtgctcaacacgtctaccttccttcattgcttctttagcttcgggccaagtcagtttgatgttttggatgttttgcatttgttttctccttttgtttggtaggagttgatcttaacaagattaaaaagtatgtcaatacttgatctgaaattattttcaggtatcatgtatgaacattaacaagagaggtagatgatgaacattactttagcaactaagaatatttctgaaacaattaacggttttggtgtgattgtagccttgcacggtaacaatgagaaatggttggcttcttttgaagaggatcgtcaacacaacattattttagatgcccctataaaagttatgcatatcgttggtgaaagcaaagtgctcacttcctcccgttcaaaagaacaaattacaaatgaattagtaaaactgcttgacaatgttcttaacatgtttgataatgcacccatcgatacaaaacgtgtcttaatgtgagaggagaacaaaatgtactattcacaagacgaagtagcaaacattaaactggcagtgggagatcttattgtgtcacctaactactattgggataacagagatttggttgaagtagtaacccatgttggagttgaaggtattgtgctctacacactaggtggaggtgttgttggggaaatggaacgttatacgacaacgaagaaactggtaagctcttatcacatgtttttacaccaaggttcggaagagtatacagctttcttgttgaaattagatgcagatcgggagaaggcacgatgaaaattgtacacgatgaaattcaaatagaagaaagtgacctgatggatttggatgcagttttggggaaggtaatctatgcaggaattaaagccttccgtgagaaggcaaacaatagcacgtttgtcatgatccccactaaactgatgcgtgttttgtatccaaatagaagtgcgccgtatacagatgaagaagaggagacaggtagaagagagtggttaaatattttagaaaagatggagaatgcttttattgatagtggtaatccagaaatcgtgtatgctgaagatcaaaggaaggcacgattagaaggccgtcttttattcactagttattttgataatctttggagctaaatatgtctgaattcttcacaatggctttcttagggatctatttgattattagtgctgttggcttaatcatgtctctaatagaggaaatgggaattaagtggaattgtgcattcggtatagctcttatgctcactccagtttggatttacatttgcaaatcggttgaactaattggttaatggaggtaatatgtttagtaaagagatgagagaggtgatcgctactctagtagttgatcatggtgttgaagttgagcgtcacgtttggaaagatgagcctcctttctttgatttggcatcacgggctaaaagtcacatgtatctccttgaagatgataaggattttattctgcgtatgcgttatgatcgagagtttagaattcctcttgacacagatcctgatgatgtagtattgtggttggcagagcatttcgcatttaacgctctacatggaagaagttttggtaatgaacgttgggatactatttgtcgtaaacataatattgaaccagaatacgggagtatgtaatgttaagcgttaagcctaagatgatcagtgaagaccagaaagacttcatttacaagtgtggacgaatctggagagagtataccaagggtaacgaggtcgtggtggttactgaacaccagattgaaatctctaatcttttcggtgattatttgcaagtgatcaaattaggcattgacagaggtttggtgcaggtgttaacattatcccaagttgaagcagaacacttagacaaaatcattgtcgagttctaagaggagaaagaatatgatctctttagaatcaatagcttttaagaaggggtataccgcagggttcaagtttggtatgtttaataaagtaaatccatattgtccaaagacacacaaaaaggaattcgaagaatgggaagatggattttctaaaggctatcaggcaaaaggttggttgtaaggagagaatatgattttaaacttcatcatcaacttgtgtttgacattgggattactctgtgcaatagtatcccctctggttggtgaatattgttctgaactggcgatgtttatagttcttggcgcggctattgctaatatgtttgtcgctgcgatttgtatgttgtgggaataggagggaagtttatgaaaaaactaatcttagccatattgctggctaccgtaagcttcaccacttacgctcaaaaatttgtagcagttaaaacagatattggtaaagatgttgtgatcacaggcaacaagttttactatacacctgggaatggtgttctagaagagtgcaaagatgttgaggcatatacaggaaaagaagataacacggaacgtcctttttattcgattatagctacttgcaaaaatgaaatagtagctattaaacaatacaaagatgcacctggaggagagtacttattaatcaagaatattaagagtgaaaaactgcaaagtttacagtaattattttaaaaggagaaacgttctaatgaaatacactatttttggagatgtggctgttgtaaataaggaatatggtgttgaagctaataaacttcctgctggagtttgggttgtcaactgcgatccgcacggtaactactctttagtgcgtggcgaaagtttctctcttccaaacactctttatggggaaactaaagaccgcgccgcacatgttattaaaacatttgctcgtcgtagtaaagaaggtaaaaatactggggtgttactgacagggacaaagggcagtggtaagacgatgttagctaaactgattagcatgtccctaatgtccacagaaggtttaggtattccaaccattttggtgacacagccttacacagatgctggattcttagaatttatgagtaaaattacagatcgtgctgttgttttatttgacgagtttgataaagtgtacgctaagaaagaagatcaggaagcactgttgaccttgttggatggaacaggaagtggaaataaactttacatcctcactaaaaatagtggctatatctcggaatattttgtaaaccgtcctagtcgtatctactacagtttcaattacgataaactgtctagtgaaactatgttagattacttggataagaacttggtaaataaaaaacacgtagataacttccaacgtttatgggatgttagcacagagttgtctttcgatgttattcaaggcattgtagaagaattgaatttctatccaaaaatgacttttaaagaatgtcttgaaatgatgggtatttctttaggcaatgatgctaaatggaatgtggcctctattgtagctaatggcaaaaccttgaaggtgaattggatcaataactggcacgactttacccctactaagtttttgtcgggtgcttgttccttgaacatctatctacaaagcttgaaagatgatgaagtggaagcaatggaaaccaacagttatgttatcctagacgaagatggcgatccacatattgatctatgtgcaactgctgatggtctaacttgtgatctgattgaaggtggtaagatcctggtgatgagcactacaccaggaaacactctgcgagtggtgctggagcctgtaacacaacgttccaccacattaggtagcgtgttctaataagttgagatttattaaacccgcttcggcgggttttctcttgtatggatatcagattaataagaggagcaacagatggcagcaccaaaatcatgggaacaatataaagaagagtgtcaaccaatagcagagagtaagcaaatccaaatcttaggatggacgggagaatggaaaggggttaatacaaaacttgatttgttgtgtcattgtggttataaatgggatactacaagtattaacagttttaaacgtggtagtggttgtcctatgtgtgcaggtcaaattaaagatttaaaaacataccttactgaatgtaaaccaatagcggaagctaaggggattaccatcataggtatcgtagaaccgtttaaaggtgcgcgtacgaaaatgatgctacgttgtaggtatggtcatgaatggaatacatgtagttttgatagttttaaacatggcagtggttgtcttatatgtaggtatgagaacacaaggaggtcacaaacaatacccgacgatcaacatattgcagatttcttttctacagggaagtttaaggaaggcactattttcaccaacacgggggaacgtaaagggtgtgatccagtatggatggttcagtgtcctgtttgttctcatgatgaatatgttaaagctggactatgtgatggtaagttttatatgacgcgtagcaatcttaaatatggacacttaccctgccgttgctctgcatcttataggtatacagcggaacagattacgtataaagtaagaaagaaaatagaaaagaaagggtatgtttggataggatggattaccaaaccatcttctataggtaagtttaaatatgtatgtaagagtcatggggaacaaaaaggaactgcaaacaaccttttaaacataggacaaggttgtccgcagtgtgctaacaaaaatcaacaacaagcctacattaattatatttacgatgagcaagatattatctgtgcactgaagtttggtattgctaataatagtaatcgccgtatcaaagaacaaaatagtcgtaatgtgtttactatgaaacagggccaagtgtggcacttccctactgtgaagcaatgcaaagatgcagaaaagcgttgtaagcgtgtccttcacacggaagcagtgagcaaatatgctatgccagatggctacacagagacagcggagttatcttgcatggcatcaatacaaaacatttataaactttatggtggaacattacaggaggaaacatgttagttgacgttcaaattatgcgcaacgaaaggatggatttctttgaagcagtagagaaacatctgatccgatgggactatgaatttgttcctgctggatgtggaccagtagagcatttagcggaagacgacgatgtatacatgatcattcgtcaagtgtaccagacagaccagtgtgaagaaactcccgaactgattttgtttgagtgtaaagatcttgcaaaatattttgactatggcggaaaagagggtcataatctctccagatacaataaacgtctacttatcttagactacatgcggaacaacaaacacaaactcatcgacgcagacgcagtttatggctactggtggatggattaacaaaggagaaactatggcacgtttagcagataaccctgtattctaccccgttcttgatctttatgatgaattgacatatgttgtggagcggtataattacaatgaagacctcttggagacaaaccttaaagtagttctgatgaaagcctatcagcaagggcaacgtgaaattttggagagtatgaaaaatgcgaataactgatgaatatgtattcttcttttcacataaagatgtgtttagtaattggtatattgcaccctttacagaaaccgaaccaggttacaatcagacatttaattgtgtcgaacaatacatgatgtggcgtaaagctttgctttttaatgatcacaacactgcacaggctattctgactcatagttcgatacggaaagatgagaagatccaagcttattacaaacgtatgggtagggcagtgtcggattttgataacaacgtatgggaagagaaccgtgagcgtattgttatgcgaggtttatgcttgaaatatgtacagaatccagatttgtatgcagacttacacctttaccaatacaaaacgtttgttgaagcaagtccttacgataaggtttacggaattggaatggggatgtatgaaccaggggggctaaaccctgctacctggaaagggcagaatcttttaggtaaatatcataacaaactgatcgaaatacttttcccagacaaaataccgcaaagacgatatttgtgatattttaacttttttcatttttagaacaaaggtgtcactttgtagcacagaaataaggctcctacagcaccgtagagagcctattattttgtcctatacaaacccttgtctttttcagtttgcatcactaagattcgatctaggtgggttcctgaaggtctactaataagattaaaggttatatcaaattcccactatccattatctcaaaaatccctcaaattatttaaactttttaagaatttacaaaagtgaaagttgaaaaccaaaatttaaagtttaggaaaattatcttaaaatgttagatacaaaacaaaactcaaaaatcaaggaaaattttaaaaattttgcgcgcccacagtatttaaagtttttttgcttttacaaaaatgaaagtacaaaagcaaaatttaaagtttacaaaaatttttatgcagatgagaatgagaagagttctcatatggaaatgcaaatgataatgattcgcatttaagtttataaatgagattgattcttatttaataaggtaaatggtaatcattctcatttagagaatgacgcgcaggggtggtgtttgtctcgcgctcccgtgtcccctcgccatgtaataagaataacagatccagccaagaaagcaagcgattattttatctttacatttctttacaaatatatagcgcccagcctaccggcgatcaaccttccaaccagtgcccctggtatgttagccccgcctttacgccgtgggggtggcgtttcctcttctgtatgttaggcattataagcccaatccctgggcttgtcaaacattttcatctatttattttcttgccaggttaggacacctaaccagaaatggcagtcacctttcgcccattgtggtatattgctttctttcccaccttctcgcgcccaggaataaccgcccgtgtaactttgcaattgataactatcctcgaccttataatctgacaggttgagaactgtttctacctttaagcccgttgcgctcgctacctggtgcaccgtgccgccttgccagcccaatgagtgcataaggtgtaatgtagtatttgtcatggtatcgccctttctttgatgtgcgccctggttggcgcggtagaaagatgatagccctttcttttatatatagcaagcaaaaagaaaataaaaaagattgaaaaagtgattgacgttcgccaggtggcggcataatatttaccacgtagggcggcaatggtgccgctcattatttggagttaaaatcatggcaacattgcacattgtggcgaaagctggacaaataaacgtggtagtaaacggttttactgagttcagtcatccccaggatgatcatgaaacggttttatctttcattgattcactgttagaaatgggagtaattacagaagaccagcacgctacaaaatgcaaacgcgttaatcagattgcaggaatagaataaaaagtattgacaacaaacaacaacctgataagatgtatcacatagggcggcggaatggtccagccgccaaaacagaagagagattataatcatggcatcatatagcgcaacaatgatcgtagctggcaccactggtaaacctatgagcggtggcggatctttcgcaaatatcaacattgacgggcgtttatccctggacgcagcgatcaccgtggcgcgggaaacatttaagaaagaatgtaatttcaacaagcaagattatctcggtttcgctattgaaaaaaccgcgcgctttgttgattataaaagcccgaaaatggttgatactacactaaaagcgcaagatgtagcgtttttgctttaaggcttgacattaacgaataatttgttaatatgttacataaagcgggaatagttcccgctatttgtaaggtggtagaatgttttacatcaaattaaaaggtcacgtgatcgcgttcaaagataacgctttttacagattagcaaaatatgcgttaatacatccccactatgtttatataagggggcgtgatgaaataaatatctttgatcaaacaacatgcgagaacatcgagatccgcaaggttggcgtacgtgattatcgtacatctttctacccttgcaaggattcagcaagtctttttaaagtatgccaattgttgaaaaaaggtggttaatatgggccgcgaatatgtgatccagtcttgggtaaaacatgaagcagatgatccgcgcatcattcccgatcatcttatcgatgaatccacgggatatagcggtgagcaaataggtaacagattagcatgtagtaacggcaacgtaaaagcgcgttatgtgcgccctggctggctggcaaatggtaacgctgatttatccagtgcggaagatgcgagcgacggcgcgaaagataatcctttgtacaaaattgatccggcttttcgtgtcctggatgaataccccagcaagatagcggcgctcgatcaggccctggaaagtaagcgcatcacctggaccgcttacaacatggcaaaaaacgtacttgatggtaaattgattcaagccgaaagaaaattagccaaaattgcagccatagcccaggaggaagacgaggagacaacggaagaggaagagtacgaagagatcccgccgttgttgtgtgttgatgcttttcctgattatcagccgacagaggaagaaaaaaggatcgcactagaaaactttgaaaatagtctttgacatatcgccgccactggcataatatttaccacgtagggcggcaatggtgccgctcatagtgaaattatgcaagaggcttacaatgattaataaagaaaatagcttgacggttggaacgattaacgctatcattctagccgttccattttgggttgtagtagcggctattattttctaaaaatattcttgacaacgttttttaatctgataagatgtatcacatagggcggcggaatacttccccgccaaaacaaaaaagggtaacacaatgagcaagcaaatcaatactatcatgtttaatctggtatctttccgcgatgatatgaaaaatttaccacgtgaaacggttgatattcatgtttcagcttatcgcgcccttattgatatgttaccgctaaaacgtgatcaacatgccgctaatatgatgcttaatgctatgcttaaaaagatgattcaaacggatcttactctggcgtatgagtatcaagggcgcttatatgcgacttacaacaaagcggtacctggtctgggaagtaccgaagagttgcacggcttaaacctggatcaaaacacttgggatagtatgcgccgcgttatggtatgggccgaaagcggtaaaatttacgaataaaaacggttgacactgtttaaacttctggtatagtttatcacgtagggcggcaatggtgccgccaacaataaaaggttaacatcatggctatcattgcaaaaactgagattataggtttagattcgatcctcctggcttatgaggaaactttaaaaatgtatgtagtgacctatggtgattatgtgcgtgaatacgaatacattgatcttgcttttgaatgttacattcgccaggtcaataaagcctataatgattatcgttaaaagttttagtcttatactattgacaatgagtgatagtataagcataataacttttatcgggaatacttcccactaaccaaaaagagagagtgacaccatggctattaatatcaatgtttccgcttatgctaccctggctaacacggctaaaattgaattatccagcattgaggcggtgcatattagcgcccgtcgctggtttcaacagtcctacggtaacacatatttttctttaatggttgacgttgagatcggcggtaaactgatcgaggtggttaacgttccgtttcaatatggctatggtgatcattttgataccgtcgccctggaagaatttagcaaggttatcaaccttgagggcaaggaattttcacgcggcgcgtatctttcccgtttttgccgtgacaatgggatcactgtatacagtcatgcaagcgatgtaaaacgtaaaaaagatttataaaaagcattgacagcacgaataaaaagagtaaactgtattacatagagagcgggaacacttcccgcctcactgaaaaagagagaaaaatcatggctaaatctaaaatgtacaacggtcacaaaaacaaaactcattggaatgtaagcctgtggattaataacgatgagggattgtatcggtttgcattgggattgatcaatgagtgcggtaataaagatcaggcggctgatttaatgtgttaccgtttgaaacaggatggaatcactacaacgccagacggctttaagtatagtaaaactgcaatccgcgccgctatggttggaatgtaataaaaacagttgacaacgtttaaaattagtgtaagatgtatgacatagggcgggaagtggtttcccgccaacaacagagagattaaagattatggctatcaatattgttcgtgtatccggcaccgttggcagttcccaggttgtagcagttgtaacaaacaaaaagattaatgatgtatgtgagatcttgaataagtgggctattgctaattttggggaatatgcaagcgttgagtacatcgaatcctaccaggtgccgaccatcagcctaaccgatctcaacgttgatcgcctgttatgcctggatgaattaatctgaaaagattgttgacaccggaaagaaaaagagtaaactgtattacgtagggcggcaatagcgccgccacatcaaagagagaaatcaaaatggctaatatccgcactttactgaaaaatgcaagtcaagttttattttcagatgatgagtatttcaataaagacattacaggcgtgaaaaatttaaaagacgtgaaggatgttatcggtattcgtggatctttacgtaaaggtgactactatggtaacaaggtgcaatataaactgtcaaaatattatgattttactttgacaattatttcataaaaccgcttgcaatcttaacaaaataaagtaaactgtattacatcaaggctgcggaatggtccaccgcctaacaaagagaagaggaaaacatcatgatcacttttactacccgtgaagccgctcgcaacgttgcccgtaaagttaacgccgccaacctgggcgctacgcttaaagccccggtaaaagatgcatcaggcgcgtggatcttccctggtctgcgtcacgctgacaagttaggtactttaagccttaaaaaataatcgttgacttttcgttatagcgccttataatgggcgctatagagaagagaaaccactactaacaaggaaacatcatgatcactttcgctattgtcgccgttgtcgctggtcaggtttacgtaaacgatacattcaccacagaagacaaggccgcaggagacataaccgccgtttacaatgagtgcaaggcagtagaaaggatgttagcgccttgtatgttaatgagtgaacgccaggacgggataacagtgtttactaacattgaaacagggtaccaaatggtagtaacaaaataaagcttgacacggatttaattttcagtaaactgttacatgtagggcgggaatagttcccgctaaaaagagagaaagaccatgaaagcacaaaatgcaattaaagagtacatccttgccgctatcgattttaatgattacggtattacaaccgaaaaagagaagatcgcggaattgatgcgccgttttaattccgagtactggtaccctgataaccaatcacgttttaattatagtattgttaaagcacttgcatcatggttacaaggtttgccatcagatatcaatatcgctttcgaatattgggaaattgatcgcttgttaacatcctggggatacattaaagagaatagcaacgatgataaaatccaacgagaaagggaaaattattggctttatattgcaggcgtgatccttgcttgctcttatgaatgataaaccttgacaattttacaaaacagtttaaattaacaatatagcggcaatggtgccgctcatatgaagaggaaacaaaatgaatacatctaatcgcgcagaaaaaattcaatcttccaagatccgcaaggcctggaacgaggaagtgatccgcaaaggcgacaagcgcaataaaacaaagcgcgggaagagtgacaaatataattggatggatttagaggattaacataacaagggcgcaccaagcgccctttctttttatatgtagaggataaacaaagatgactttaagcgagcttaaaacagcctacaacgcaacgttaaaaatagccgtgcgttaccgtgatgcgtacggttttatcgcgcagggcgtgatcctgggcttttctgacgatggtttgatctatgttgatgcacatcataacaaggtaaaacctgaaaacgtcattagcataaaatatctttaaaagtggttgacaccataaccggacctgttaaactgtattacatcaagcggggaatagttcccaccatacaaaaaggtaaatattatgatcaccgcaaaacaagaaaaaatcattatcgacgttgcagccgttgccgctattgctattattggatcttattatgacaccgcgcgtccttcctccttgcatgaggtcgccgccgttgcatcagttggcgtactgttttacgttggtaaacgctatttatcaccaatgattaacaagctgacaccgtggaaaaataaaggttgatcctgttttatattgtgttatagttatcgtgtagggcggcaatggtgccgcgcccctttgaggatgcaatcatgagtaaagctaacaccgtgctaatgttttccctgattaatgatcccgcttacttgtccaacatggcgcaggagggtaacacattaacggcaacattcaccaataagcttgaccgagtgatcatcatctcactgaaaacagttagtaaaggcttttactcgttagcttatcattggatcactgataccgatgagacaagccaggattatagcgcccctttccctgaatcaatggcacgggagatcatcgcagccgttgtaaatgatggtttgtttactgcataaaaatttagaaaaaggcttgcaatcattttgagatagtgtatatttaattcatagggcggcgggaatagttcccaaagcaaacgagaggattacacgatgagcaagtacacagtagaatacacggtagagaatccggcagtatccgaaggtaaaaagatgacatttgccatcagtataatcgctttcgttgtcactatcttatcaatcatcttataaggtgcacaccatgaaaacaacagatattatcaaagagatcgcccttgccgctgacgttgagatcgaggaagtgatcgcgctcaatcttacagaaaacgatctgcgcaactatgaagcggaaagcgtgaaagcaagtggcgcggtcctggcatataatccggctaacaaatagtttgacaagctgaatcaacctgataagatgtatcacataggggcgacaagcgccccgcctaacagaagagagaaaaaatcatgaccatcgttaaattaacaaccgaagaaatgaaaacaatgttaaccactaatttacaaaattggaaaattggtgttgacgttgaaacagtgtgcaagttgaacgacaaactaacaccggacgacattgaaacgatcatccgtgcagatttctatgatgctttatacgatgattccacagtccttgaaacgatgttggataacgcttggatcaatcccgatttggcggcttatggtcatcttgcctttgaagccatccataatgtttataatcgttaagggggataacatgaatccgaaagatatgcaagcatggaaagggtacgacgatctaagcgccttgcgcaataagtcaagccgtaaccttagacggttggaagcaaagaaaaagaaaaaatagtttgacaagtccgcctagtctgataatatgtatcttgtagggcggcaatggtgccgctcacaagaagagagaaaaatcatgaaaattacaaaaagcctaactaattatgcagcacgtcgcggattatgtttaaccgttgaaaacttagggaaagaagactttttgtgtttttgggagcttgaaaatgattgcgagtggatgttttcttattctatctgcgaagatcaaaacggttgtttgttaacctggcgcggtaatatctatttaccggaagaaattaaagaagagttaccaggtacgatcatgacagagagacagcttaaggaagtgatcaattttgtagggcaaaacattaaaaaataatttgacagtaggcaaacaacgtagtaaagtttattacatagagcggcggaatggtccaccgctcacaacagaagagaaacaaatcatgatcccgactatgttttatgtatcgcgcaaaggtcacaatattttttggtctgaagatttaaatgaagctatgacgtttgcccgtgatcgtgttgctatcggtggcgttaatatcaccgtaaccgatgaaaacggcattgaatactataacggcgacgatgaagagtaatcaacaaggcgggattaatcccgcctgtattaaagggtaatataatgaaaactttcaacgcaacagcctcgacaattggttatattattacagtgcaagccgttgacctggtagcggcagcaaacaagattaaaaagatgatcccaacaggcagcgaattttccgtttgggaagtaaaataaagcttgacaataatttgttatctagtaaagtgtattacgtagggcggggcaatggtgcaacgcctactaatgagggtagaatcatgttagagaaaattttcacggttgtaatagtgggcctggcgttatcggttggagtggttgcaactatggctaacatgatcctatcttcccacggtatcggttaaggtgaaacaaatgatcacgaacaaaacaggcaaaacggaatttttacgcggcttacaagttggtaagtctgagatctggcattgcacgaagtccgcgcataatgaaatgaaagatttcaccgctactttacaacgtgttaaaatatctattacacagaaaaaagccttgttagtagtagaaaacgagatcccgcaaactattattattgtcgagcgtacagcatgaaaacagaaatcattattgaaatcatcaacggctataaagaagcctttatttttgctgaatcagcaagggatcatgaaggtaattttattgataacttagacgattatgatttttctcctagcgcggatcaacggatcgcccaggatgtaacagcctttattaatgctaatcttgccgctatctctgaggcaatgagcgacggcgcaacagccaaccagatcgggaatgatttacattttacccgtaacggtcacggcgtaggcttttgggatcgtcctgaaatatacaccactaacacagccaaccgcctaaccaatgcagctaagtttatgccgaacgtgtcggcttacattggtgaagataatttgatttatattgaataaaaagtattgacacagatcgccagtgtgctaatatttaccacgtagggcggcaatggtgccgccgataatgaggaaagtaaaatggaaactatcgctattgttaccgtagaaaagctggttgttggtgatgtattcgcgttaatggtgcctaacagcagcaaactgggcgcttatgaagtgatggatcataaaaatgaatcatttggcgacggttgcacaatggcggtaaaatctttaaaggatggaatcatccgccaggctaactggcacaaagggaatcaagtcggtttaatatcagctaatttcttgccagaagagcaaacgttagaccaactatcaggcggtaagacgttagccgaactactggaaacagcgatctaatcaacaaaggggcggcaacgcccccacatcagaaaggaaaagattatgagtattgcaacagtattaaacgccgttaaaaccgctgaatcatccggcttacatgttgagcttatagatcaaccaggtggcgatctccttgtccaggtttacccgccgaaagtaggagatgattattattggtgctattctgatacgttcgaacaagtagacacgaaagcgatcacggcttttattttaaaagctattgaagaaaataactttcattataacatcaatcaataaaccataagcagggcggtaacgcccaattaaacgcaataggaagaggctagaaagcatgaaaaagatgatcgcagtagttgccctggttgttggtattaacgcgcctgtactggctaatgagttgcctgaatccatcacgttaaccgatatcaacgcaataaaccggatcggcgttaattatcgcctatgccttgccgctaaaactttccaggacggcacgacagaataccacggattcgagggtatccgttgcggtgagcttgcacgcgaccttaaggaagatccagaccttgaggccataccgatgaccgtaaacggtaaagcttacgtaaaccgccaacaatgagaaaggtaatcatcacaatggggatcgtaatagcaacgctggcgcttatccccttcatggttgaacatgtgctgatcaatgttgtcctggtagtcagtgacctattggaaacggttggcaactggttttaagataaataaacagggcttgtttttgtcctgttttttgttatacttattgaacgggcggcacctggaagcaggggaagataatcaccggaagaccccgctatatattgatagctaacatctatcaaacaacaaaacatcaaagagataaactatcaaatctttacaatcctacctattgacaccggatcacgcttacattatcatttatcacgtagggcgggaatgtttcccgcctgatttaggagtcatatcatgatcgaacaaattaaaagcactaaaccaaatgttaacggtaatgtttctcactttatcggggataatgaaagaggtacaccgtacgccgccgtaaccgttcaaccgaacggggattattggtttaccgtgtacggatcttactcttttggacgttcggcacatgataagatcttgcaagtggttaagcctactgggaagaatatcacagcagaaaaattttataaaaaataacttgctttatagctcctgttaacttatagttattgcgtagggcgagcaatacagcaagcccacaaagaggaaaataaaatgagcaaatcagcaattaaagcacttgaaaaagcacaagaagtgatcgcaacgtcaaccactggcgcaaaggttaatcttgttggttatctgacagatgaaactatccgtaaaaattggcgtaatgctgatttactggcttgcttattgattaatagtgtcgctaatgctttccagtgtgaaacagccgagagcctggaggaaaacttgtttgataatatggatcaagccattgaaacctatatacaatcaaacatggatagctggaacagtaaaacatggcccgacaatttacgcgatacaactgatcaactgatccgccttgccctgatggttgaacgcgataacgttcacaaccgcacaaagtaagattatacaagggcgcactaagcgccctttaacgtaaagaaatgtaaataatgcgctatcccctattgacaggggatcggcgttatattatatttaactcactggcagcaaacaacgaaacgaaacaaaggacaacaccatgaacattaaatcaaataatccagcttactccttcgataacgctttttgtcacggtagcgccgccaaaggcttcgaaatcgatggtaaattggttatcgtgaacgttgacggggaagaggttgcagtatatccagtaaacgatgttaaaagccgtttacaatgccgcatggatgttaccgcatatcagcttgatccggtccgtgtagttgccctggtattagaggaagagatcaaagcaatgcatcacagcaataagtttattggtgacgcgcaggataatatgaacgtttgccgccataaagttaatgaagccttgaaagaatgcggttttaaggatctgatgatcaaacgtgatgaaaaattccgctttcgtaatgacctggcaaaccggatctactcaatctatgaagcgttataattgacaacaaaacaaggggcgcactaagcgccctttctttttgcctgaataatgttgatagattccgcctatggaaaaccgacacagaacaaaactgaataaatagcggtatcgagctaatcaaccattaaatgaataaccatacctcccagggtaacaggctgttagagagccatttaaagcggttaaaatcgatcaacaaccaacaacaaaccatcaaaaacacccttttacctcctttctggtgcaatgataaccattatcatctatctatgtttatctatgcaatataagtgcataactataatgttgataatagttcgcaacaactaactaaccaacaacctaaaacaacaagcaaactaatcataatcaaaggaataatagcaagatgattgataacgacaaacaatcaaaccatgatgaatactaagcaggataacgataacacgacaaaacaaccaactaacgaacaataacaaacgaaaccattaaaagattaactattagcaaaatagtgcctgaatgaaatcattacaaaacgaatcattcacaggatcatcattagcacgctatgccggacacatagcgagctaataataagccaactacaccccaacaatcataaccatcggtgatggttatttcttgttactgcgtagcttgcaataattgcaagcgtaatgacgcttacacttattgcgctggcttattattagcattatatgtaattaccaagatcataacgttagcgcaataacaataatcattgtggtaattacgtaaggaaacaattagcatggcaataattatgggggcaatgggaggatgattatcatcattccgatacattgcacactatgcacataatagaataaaagtcaataattttgggggcgaaatgttaccgccacaggcgggaatgttgagcactaagagaagagattaaaggaataatctttcgggggcgaatactatcgctacgcgatatgttgagcatcttctcttaaacgtaaataaaatcagaaaattcttgatttattttagtttatatgttaataaacgtttaaataataatcattctcatataaataatagtctgcttgtcatgagcgggattagttgacattgttccgtcatatgatgaagttgccaaaccattgataaataagtgtttgtgtgatttataatcaagtggtccaccttgtcgctacgttggcatgagccttgcataagtcattgaatacgaatgataattattctcattcgcatgatatttgggaattgtcgctgcgtggacctgacggcccgaaaattcgcgttaagcacttcttacgtatgcgccatgatttttgccatatcatgttgattctattagatattcttgccatgatagccatgaaacatggtgtcccgaaataatctctccccgtagatattttgggttactttttatacaagagtggggtgtcaaaaataatcggtatatatgggataattgataggaatcccctatgataattcgattgtaattccctaagattgatcgtatgatgttggtgattgatgattgccatgaaagatggctaacgatgagaggagattgtcatgcaagagagtaaaaatgttccgttaagtagtgcaacattgcttcgcttctataaagcatggattgccaactatcctgcaatgaatcgcacaacgagtggcttatgtggttgtctggtagattatgtagatgattttgttggtgagacaactagagaagaagatagaaaatggcgtgatcatttgttagaccgtttgaaatatgaaatgaggaaacaatttacatgtgcagggctggactacaatcttccgttcaatgcagattgcatggattacctttcagagtgcataaacttggcgtgtcataccaacacgttacgtcttcagtgggtgaaagatcgcattgaagatgcaaataatgcttgcattgaataaagatgtttgtataatggatgacataacagatagccaatgaggagatgaaatgaagaatttgaaaactgtcacaatgttcttgactgatcctacacgtgtgcaagcactggctaaagccagccgtgtagctgtagaattccaaaactttaagccgtccgttgtgacaggcagtgaaacgtgtgttatcgatttcattaacgaatacttccgagggaatccggttggtcgttactttattaagggtctgaaggatgcataacatgaaacgcatgaaaattcgtattgagaatgatggtggttataaaggattggcacatgcaaaatttccacttgtgttggaagctactgtggaatacagtgggcttgctcatgtgcgattctcgaagatgatggaagtgcaggaatggttttgggacgagatagatgcacgagaaggggaagattatgttttctttcctcacgaatatgaaattgtctattaagggttgtgtgcaatgatcacaccacaacagaatgaagcagcaatggatcttctcgatagtttgtatttcgataattggtactctgaatgtgaatggatgaatatgcaaactctgaaagagaagacaaaagcgttgattacagtagatcaatttcttgcagagacggaaagaatgaattatgatatggcatctcgcgcacgacgagtttccattttcaataaaatgttggcattagggggaggtagaaaatgagacaattcactatactggcagcttatgtgcaatgtgttcacgattatgttagtgctcatacaggtttgctggaagttaccagtaaaattgaaggtaatatgggtactgtctgtgtgcaacatactttatccaacgtgccgtttaaagtgttcactgttgtagctgctgattacaatcgtgtagatgtgcgtttcttggatcataattttcgtaacgcactagataatatcgaagattatcttcccgtgaaacctttgtcatttccgccgagtcgtgcaaataatgtagtgacaaaccttaatgaaaggaatgtggctatgcacaaaaaagtccgtcaactgaaaatgctgatggaaatgcaagaagagattgaaaaagaactaaaagaagattttggtatgcttccaaaagacgctttgaaatggtatgatgaactaggaggagagagcaatgtttaaagaaggtcatgtctaccgtttccaggatgaggattatatgcgactatattctacctttgataacagtattgcggctatcattggagagaattttttcgaggtgttgagcactgatgtaaatggtaatatcttgtcaatggttgtaataggtatgagagatggtattatcagtgctggtgatggggatcgttacataatcaattctgctcatatagattattttgttgacggtggtgttcgtggtggtcgtggaaaaccccaagaagaacctgttgatacaacaaaagaagagtggtatgttgtaatgactgatgacacctgtatttctggatttgaaagttatgaagaagctttgaaagaagcagcagagcataaaatggctaatcctacagaagaggttgaagtttataaacgtatggttgttgctaccatcggcgtatcttttgtttaaaaggggaatgttatgtttaaagttaatgctgtttactgtttcaaaagtaaagctgcctgtgaagctttctctatgatctctgatgaaaatttcaaaatggcagctttgattgaagggtcttgtttccgcgtcgaagatgttagtgaatcagggtccgtttgctcattgactttattggacagtggagatattattgaagctggaaagtatccgttcaggagttgggagatattgttagctcgcggagagcgtaacttttttatgtgcgtgtctgcgggggaagttgtgaaagaaactaaggatgtttctgtttacaattctgaatttataagttatagtgagtatcaacatctggaaggcattgttggtcacttgttatctctgattgatattgaatgtgacctgcctgaatcattgaaagaagaattgaaagcattagatctgttataatgtttcgcacaacgaaaggagaataagatgaatctgactgaacagttacgccgtattgcaaaagaagcttccttcaacttccctgttgaagaagtgatcgagacatgttttgctgaagcacgagcgggaaactcttcaagaaatttcacgccatctgattttggtttggataattctcctactcatccaggggaaatctacaatcaggtgaagtggatggatgaagcagtagcaattcttcgtgagcgtgggcttattgtttataaagaaatggatctgaacggggcatacgagtggatcactattgattggtccgaggtgaaatgatgaaaggtaacaagatgaaagttaatcaagtgccgagcgcatacactttgtggcttgcgcgagcattacaccagacgatcaaaaaccctaagaagccaatgaagagcgggaagaagtttatgtctaagggcaaaacaacctttggcttcactcgtatgtctgttaagatgaaaagactggggtataagccaaactacgctcgttacccttctgaatacaactggtttgactaaagaggagaacaaaacatgaaaacatctattcgcgtgaaacatgatccgaacagcagttacccatacgtgtatgttgaacgtcatgaaggggactattataccataaaacgtaaagtcccaactgatacagggtttaactttgatgttattgcgctggatgatcaaggtgttgataatctggtgaatgcattactcgcattgaaggaagtacgatatgaaaatcagactaaaggtaaagtggctttcgattcttgtgatcgtttagccgaagagattgccgaatggcgtgatactcactaaaataggagaaagattatggctacttttcaacaactgaaagatgtttcacgtttagtaagaaaaatccgagaagcagacgctgctgtgcgaaatgcgctaacgccagcagagcgtgaagatcttgaagaggaggttaaaacagccgagaatgcttttgctgtgtatctttcaacactgtacacagggggttaaatgtcagaagaacttaaagaattttatcaagcctatcataattggctgttagctggtgctccagataataatcctttctggcacgataaaggtttgtgcagttgcctctatctttggtctggtggctatgatgatctaaattatgaaatgcaaatgcaattccgcgaagcagggttgtctgaagaatacccgtttgatgacggagactggtttaaatatgattttgcacaaagaaacgggctattgcatttgaatgctgcccgtataaaatgggtaaaagatcatgctacacaggaggatgtgcaatgccaatagtgtttagtttcttaataattgttatggttgttcttttcgcggcatggctttggcattttgacccaggagcagcgcagcaaagagctacagactggaaagaacaatgtattgtgctcaaacatgaacgaaatgcggagaaatttcttgacctggagtgtgatcgccttgtaagatacaagcaagataaataaccttgaggtgcaaaatggtaattgagattaaacttgaatatgctggggctgttgctctgatcgcacaaacgttgggagcaaagattgaagaagtgtgtatcaatgcctggagtgtagagattgatgttcctatggataacattgctaatcgcttgctggtggcagagtgtgaacgcaccaacataatctacaaaggagcataatatgaaaattagagtttgtgatgtattgggttatgttggttttgagaatgttcagattccttttgttgttgaagcacatcttgttagtgatgatatgacaacattctttgttacgatagaagaaatgtccaaagttgagggatgggagtggtttgaagaagatgtttgggaaggttgtgattacgtatttttctctgacgaagtgaatgttcttgcggagtaagtatgtcttgttttacaaaagcagtgtccatatgtaagaaacagtatgaaagtgattacggaatatttaatattccagcagatcatacagagtattgttcatgtggtggcagaatgaagaaaacagtgatttatgcggataatggagatgaacttgttccagttatggtttgcaaagcttgtcattctgttaaaacattaaaagcgtaaggagtcgggacacccgacgattggagctaaaaattttgcgtacaaccctttccgcccaacaggggcgcgtcgggtaaataaagaggagagtttatatgaaaaagatcatcgtaggtttcttgttactcatcgcatcacttggaacagcaaatgcgtctcaagtttatgagtgtgtgtcagatgtggttgttaaaaatctgaaaggtgaagtgatttctggtcctaagaaaatggcttctgttgtcattaataaagataactcctttatccttaaaaattcaggcggtgctttgatgagtggcattctgcaatacacaggagaaaaaagtaaagatggtagtgctatgtacggttcacaacaatttattggcactactgaagtggttatgctacgcacagaatatcgggacactttagcttggtttgcatttcttaaaaatgataaaacaataacaaatgttcttactctagaagctgattgtactcaacactaagagagttcaccgtaagatgttcgaaatcatatttttcactgtgtgtatatttcttttaggtagcttagtttatgaataggagtttaaatgtctaaagttaaacattatggtgtaaattggagtgatgcttggcctctatgtaaagatgaccctacagaagggacatttgtaagatacgaggattataaagaattattagatgctgtgatcgcattgttagacgatattcgttcacgttatccaggacaagacttcacttgtcctcacattcaacttcttgcttgtctagtagaaggtttgccaaaggaggtagaagaagggtttaagcgtgtgcaatatcaaggtgaaactctagatgttcctgaatttgttaattatattacaacagattcaagtggtgatcgttatggttacagtcataagccagagattccagatttcgttcatgcttggcgtattccttatgaagtaatcaatgttgcagattgttggtatttaggagaaggagacagccgtaattggcgtgactctttgattcaggtttaacaatatgaaagaaacattgccagcagcatatcgtttgaatgatgaacgtatttgggagtggaccgacgtttcttgcttttaccccgaaatagttcagtattggcgagcaaaagggtgtgttgtagttatcaatccttgtggaccagtagatgaagattgcctgtatctcgatgggaagtggcacagttattgtcgctggccttttgagtggatgtgtaaagaagatctcccagaaggttgggagtatccgaaagcaaataggagataatatgtctaaagattttgttgaagtgtttgtcaaagacgaagaaactggtttaggcacaggtttcatttgcgaagaaacttttaagcgtgaacaagaaaaagctattcttatgcaccgctatgatcatgcattagaacaatggaaaaatgcagaacaaaaatgcaaaaacctttacgcagaaaatagaaaactacaagatcaaatggagttgttagctatcagtttacgatctctcattttggctgtagaagatggttttaaaaatccagatggttttcctgtgagcgatattgaacatgatttgtatcttgctcgtggtgcttacttttatgttaaacagaagtctgtagaaggagagaagtgatggaagaaaaactggaacgtattatcgagttagccatgtctattggctacgacgattgttttctccaaactattggagaaacacagaacgattacgactcttgggtgaaagagttggaagaactcaaaacttccttgattgctgactttgctgaagccgaggataaagcagatcgttacaactatctgtgtcgataagccttgacatttattttatgtatggtatacatacattatcaacgtgagcaaggtggtgtaatatgaataaagatcggtttctttctttagtcgcggaagctccttttgatgttcttggggtgagattatggaaagacagaaactatgggttagatgttcaaacatactctctttggttggttggggagcacagcttagatgaaagcttgtgcatgggtagagattctcgttccctctgtttaaagttcagaagcttagaacgcgcaaacaaagagcaagaaaaactaacgaggtggctaaatgaaaacaagcgcaaggttgatggagttttataaaatttatctagcatggattgatgttggtgctcctgatggtaaaccttttcggcgggattgtggtttgtgtgccaacttgttcgattatgtgcacagaggtaattacaaccccattataacaaccttgtcagatgaaatgcacgcacagttttaccataaagggttgaatcaagaactccctttcaatgagaactacgatgcatatgtcttagaatcagatgcagaggtatgtcacctgaacgtggacaggattaattgggtaagagatcgtattgcagaggaggaggatgaataatgtcggattataactggtatgaacttgaggctgtttgtcagttttacgactcaatagttctgcgtgatccaatctgtcaagaattaagtcgccgtgcaagtgcattggcaatcaatgttaaagtgcacgattggaacgcagatttggaaaaagaattggaattccttttggaaacaacccgtgtcttccataaagtgttccctgaatggtttgagatggagggataagcatgtggattgtccgtcttaagtatgatggcaagtttccgtgggagaaagatgtttgtgcctgtgattcagcagcacatgccaaagcagcgggtcaggcagtagttgacatgtataacaacaccccctttgatccagaaatggcaggtgttacaatgagcatgttcacttactattcttttgaggtttactatcatgaaggagagtggaaatgagcgaagaactattaacattttaccgcacgtatttggcatggttggaagctggtgctcctgaaggtgaaccgttcacccgttgcacaggtttgtgcacgaacctttatgatttttacgacataggagaaagcgaacgatacgaacctgtactggatgaaatgcatgagcagttctacctcaaaggtttggttatggtgttgcctttcaacagtaattttggaaagtacaccttagaagcggaaaaaagccgttgtcatttgaatgtggatcgtgtgaactgggtaaaagaacgtgtagcagaagaaataattggttgacagaaggatctgtctttgtcataatcatctcatcgaaacagagaggagaaaatcatgaaaaagtttatttgcacccgttccactaacagtgatatccttgtaggtaaggttatcaaaggagaactcttccatgcaaacggtaagaaatatattctgctgaaagattctttcaacggggaatatccgcgctgcactttcttcaattacaacactccgtttgctttagaaggagatgcttgggactgggctgaacttcatcctttctgtgaagatggacagacagaagagcaggaagaatctacgggaagtttacgtgataaactgcgtaataaagcactacaagcaaattcccattttactgaaatggtagacgccgttctattagagattgaagattgtgcggaacaagggaagtttgaaaaatactttgaaccttccagttttggtttgtgcaataacccttcttcttatgaacagataagtgaacagaaaagaggggcaaatgttgtagctacaatactacgtgcaaaaggtttggatgtaacattggcaaccgcagagcacagtatttttgggattatcaaacacatcattattagttggaactaaaggagagaatatgcaagttgaagacctgatccacattctgaataaagccaaagagaagggtgctatcaaagactggaaacgtgaaacaagtgaagatttatctcactgttgtcgagaattttacatcgaaggtattgctaacgatcattatactattgaatggtatattaacttaatgactcttaaacacggttcatttgaggtttggtttgatgacattgatgtaaatggttttcatcctggctataaaatcgctatgcagttatcttatcgtagagaagttgtagcacatttgggtttacataactaaggagaaaagaatgcaagcagttgttaacgaagctattatgaacttatctttcttgttagctggtttaggaggtgttctcataggtttggctcttatctggtgtattcgtcgattaatcgggtaccgacaaaaaggtgtttcatgttttgtatcttacaattttacaactgcttacagcaatgaggttggatctggcaatgctcaagcatttttaccaacatatcctcctacggtggaagatattagaaacttggaagtagaacttatgggactaggtgataactatacatctctagttattcaaaatatttttcgactaaaacagggggcgtgaatgaaggtacattaccctcatccatttgatcctaaaaacaaagccgtaattcttcgtcagtggcaacgggtttgtcgtactaaatgtccaatcaatagcccacacaatgtagacaaggactatcttgggacatttgttgaatacacttacatagacaaaaacaagcgtaaacaacatgtcgaggaatactgcttaagagtagaatggctgtaaataataaataccttgacaagtgtttattcgttttgtaaagtgagaatacagcaatggtttaggagtggttatgaaaaagtttgttgtttacagtcgtctttctaaacagaaaaaaggtgaggcacaatatggtatggagagccaagagaatgatatccgttacttcttagactctgtgcctgatgcggaagttattggtcaattttctgaatactattcgggtaagggcgattggaagcaacgtaaggaactggttaaagcggttgaaatgtgtaaagctaccggagcaactttattggtagctaaagttgaccgcttgggtcgtaacaacgcctccgtagcaactcttctagaaatgatcgatgttaagatagccatcatgccagacgcagataaaatggttatacagcttctgtctgttctggctgaacaagaagttagaggtattgctgatcgtattaaaaagggtcttgctgtagcaaaaagcaaaggtgttttattaggcagtgctaatcctaaaactgccgctgcacgtagaaaaggaaaaatggaatacaactctgttaaagcagacgcttttgcagagacattccgtgaacgtttggagatccttagagatttaaatacaccttacaaaactattgctgaaaaattcaatagtaagaaaatagcaacagcacgtggtggtaaatgggatgctaaaactgtttctcgtttgtgtgccagacttaacattaaataggagaggatatgaaacaagaaaatgaatctgtagatcacttaatcatgctgtcagccctttttgccggatgggacgtattttttgaaaatttgttcaattctgctacagatggttctgattttatgcgccaatttaaacgacgaactgttgaggactatattttctattcaggtcggattgaaaaaggttacgaagatatagatacaatacttacaattaaagttttagatgtgatgtttagtgttatagatgctattgatgaaagtcttccgattttagaagattgtaatacgaaagcttatgtttacaaaatagcccgtgcttatgtgtctgcaaacagttgtcttctttccacccaaattgcggtgaacaattttgccaacttgttcgatgaaggagaaactttttatgacaattgatttgaagtgtaagaggattcttttagatttctataataattggttagaacacctccgtctctttccacgagaaagtggttacgctgatgttggcttatgccgaggtctacgtatgtatataagtgatgaatttcgagccgatcattctttagcatattctgtttatggtatgcaattagccagttttgaaaatgctggtttagatacaactttcccgtttaacacagcaaaatcttttgagcaagagtgtaaggaaaaacgttgcatgtttaatgaaaaacgtgtacagtgggttaaggatcgagttaaacaactagaacaagatttggatttcttctatgatgaggcagaataatggatagacaaaccttaaaaacaatggcagatgccactaattccccgtactttgaaaaagtaagtaaattggtagctcaagccgcagaggaaggatattataacataaacatccacaacccaagtcttatactagaaatgccaagtgataagaagatacaagagagtatctgtgaaggtattgttagttactggcgcgagcgtgggtgtggtgcaaacatggctttagacagtgcaaacattgtaagatatataaatatttcttgggggtgattttatgattcaatgcactcatatccaaattacttggagagatgaactttaccatttaggacaatttactgtaggggaaacataccctgtcattaaacataatcctaacatcgcaaactttgacaggatggttcttgttgaggacgatctaggtcaaacttattctttagatctaaaatatccgttttcttacggctacgattggatcgttacttttgaagacgtggaggaaaataaaacaatgaacgaaaaaaattcttggtattatcgttgtgaactgccgccagtaggtgaaaaggttatctttgttcctgatttggaaagatattcttgggacagttcttattctgttcctaaagaaggcaccgaagttgaagttattgcacatcgcacaacttcgcatggtaacgatgtagcagttgttttctgggatgatgaaggcgctgcttgtgcagggggctttgttgcaggtaattttgaacccctgccagatcctttgaaggaggcaattttaggcgtagcttcttttggactctcttacacatctgcacaagagatcgtagaaggtattttaaacggtaccgttccaaacgaaatttttaaacagattaaataatagttgcaccccgttctgcggggtgttattgtatatgtaaaggaggcgctaatgtattacactgaagactacatactgtataacttttttaaaggctggttgaaatgggctgaacaagctcctgtcggagattgtgtttttccttgggattctcgtcaaggtttgtgtcgttgtttggaagattggcttataaccacaaactacaattcagagactaagaaatctacatcaaagagactaaaaatgttatttgaagaagatggtttagatccgatttatcctttcggtgctgaaagcttccacaatggtctttttcttggcactcaacattatgacaaagatcgcgtagattgggtaaaagaaaaggtagcacagtatgaatggggctaagacttatcatcgttggttagaaagttatattaagaaatgtgaacttggtgttccaggctatacttacgacacggacgagattcttgatgaaatggaagtttggtttaaagagcctcgtgaactattggaaaacattctaatggcttgggatggtacggcacaaagcattgaaggaggtagaaatgagtaagaaattgtttaatattcgtgagaatcgtgatggatcgttctctgtagtcaatgagtttaacgtttcggttgggacttttattactaaacgtcaagcagaacaagtaagagatactttaaacaagtaaatttttaagggggacttatgttaggtaagatcaaagcttttttcaaaagtattattgaaggaagtccaacagaaggtgcattaggaagatctctaacaggagaaccgcttgccataatttctatcagtcggtatggtggatattcaattaaacaaacacctttaggtatagaaggtagtatgctttcttggacaatatctcaagttggtgataacagacttgcagctatagcattgcttcgtggggagtatgactattgtttatcagcatcttgtaaaaagcacctcatagagcacattagagacagagtagaaagagaaggcggatacttcttcgaaactaagagaaacgaacaaggaactcttgacttcactaaggtttactgggacaatcatactcgtcaaactgttgaacaacttctggaggaaagatgttaaaagcttttgctgtatactctactgtaggattcttttattggattatagttattgtcggatgttggttaggttcttgtgttgtgatgggagaatggttaacatacaatgtattcgaatgggatgtagtttgtagatcattacttgttatatggactgctattgtttgttggataactgttagtctaacattagatctatattgattaatagatggtagatagatgatcatagtttatctaccttcacttacgtttcatacctcactatcgtgagtaacatgaaacattattatatagaaatctactactcgctatcgctcgtaaacatatgtttagggtaccatatttttttgaaaaagtcaatgctgattcacctatcaattatctgtttaagataagtcttacctatcaatctaactcttaactagtattgcacctatagtaagactattcctatagttattaaccctcttcttctgtagaatgtaattagatccttgacaaactcacaaagcttatgttacattgtgtctcacaagtgaataataccgaacaggaggaagaatgagttccaattttctatacaaagcaaaagattcacgagatggagagaaccattggtggttgatcacagaagatggtgttatcatcctaccgtgggacggagagacgaaagttcaaatactagagaaagtaaaaggtgttagttttaatgttagtcatgatataacaactttcaaagcttttgctatgaatcctagtcttgttgctgaatggtaatccaggagaagatatgactaaaatgtatgcagccgttgataagctggatgggtctgattctgtttttattttgaataaaatgggtgtcttagtttatgcccgaacttctcaaaacatagagcaccaagtggaagcagcacaaattttagagcaaataacccctccatacctatactcaaatgttgagcgttttaacgatgcacttggtttgacgttaatagcggaatggtaataatggcgaaaatgttgaaaattgataatgtcgtaacaatcactacgtctataccttgtcctcctatgccttgcccctattgtggtggtgcaggatatgttatggcggatgtaggtcaaatttacgagtgtaacccgtgcaaaaccacaggttatatccaagtagaatcagaggagaaacactatgagccaaaacgttaaagaaaaagaagtaatcacggtaatccgtcagatggaaggtgccgaaaacaatgcttttgttactaagattcttcttaatatctttgaagatgttattttaaacaatcctggtcataaagattatcagtatgatgttatgatgggtgctttgcttgagattaacaaaaacacttttgctgaatatgagcaacacatgcttttaccagaggaagatcaggattatttgttatctggtgctttaagtgcacaagaaaatttctaccacgttcttaatatggcttatgcagatgaacttgctgtctcccttgaagagcggattcaaatggttcgtgacgtaatgaatgaacaaatccaagaagttgaagatctggtagcagagcctttagcagaaattcgtgcagctattgaaaaacaaaaaggaactcaatcatgatgcaagtaggtgatgtggtttgtcttaaaggtgcaaacaaacaaatgacagtaatagaaagttatggtgaatcttgtaaagtaacttggtttgatgaaaacggggagttgcaacacgctatattcgatcaaaaagctttgaggaaggttgaagaaaaagaatgagccatccgtcaatatttttctgttttgtagatcttgaaaacgagtctttaatcgttgatagtgagggttacttcacttattgggaatccgagcacgaaactataagtgtagtgaaagaaattatgcaaaccaatccaaacctaccagcacataagtacggtattgcaaaagtgtttgttactaaaacagagtacacaaaagagcgaagcactttgtaccataatattgaagtgattcactatttcaaagatgttatttaggaggttatatggaagagaagatttgggatggtaaaaatcctttagaagttggacacgtagcacgtgtcaaaaaatctactacaggtcctggtttttctggtttgtatcatataccagaagaaggtcagcacgttacaattttggctcgtgacaaacaaaacggagcaacgcctgtgtggattgttcgttggtatgacaaagatcttaacatttgcttgtcacctattatggctcatttgctggaagccccttgctctgaagaagctctaatttttgtttcggcttttcagaaagccacaggtttaacattagatgcaaaagatgtgcaaaaagcatttgacattattcaggaagacaacgatactacatctaacgacgaactggttgaagttacaatcttatcttcagcagatatccgagagattgataattgtgattttccaatcacatttaaaatgtcgcagaaagacatacagtcatctggaagttgttttggtatacctcgttggttttttgattctatcaaaaattctaatacagaaggatcagactatgatcaagatgacatgctttggttcttaaaaaaccgagagattgttctctcaccacttaaataaggagaaataatggtttcatttatcgtaggtgtagttgtaggctatcttattaacaaatatcaagacgttatcacggcaaaagtaaaagacattttagactcatctaaataatctatcaaagctgcatcttcaataggtgcagccttttaaaaggagatatggcatgactaaacgcactgattttaaatgtatgcattgtgggaaatcttttggggatcatcaagctcgcacattcaactgtccacgtaaaggtcgcggaaattttaaaggttttaatcccgcacatgtttattctccagattacgataagccagaagaagaaaaatttgttatttaataaggaggtcatatggaactcgttcaagaattgtataatgctttaggagcaaaaggaaaagattggcccgaacatgcgcttattgctataagagactccgatggtgagattaagttttcaagcgtaagtaaagagcacatcgtagaaacaaaactgggtatttacatgcgtggaacttattgcttattcaacaccagaatggtagaagctcctgttattgaagatggaacaaaagattgccccacaatcgtaacaaaagctgaatatgagaagtttttctacgctaaggcttgacacagaaacaatactataggatagtgatcctatcgtagcaatagaacccgcttcggcgggttttttcatatctgtagcaataggaggtcgtgtgttaaataaaatcgaagaaggttgtatggcatttttggtagataacccgtttccctttatggttaaggtccatgtaggagagtatttaggttatgacgaatgggattgtagtatcaatagtgaaatgcaccactaccaaccaacaatacttaagacggatcaaatggcgcgtattacagtagaggatgaattgatcattgagttatacgagagagcactacacaagtaagctagaacccacctaaatcgaacagagacgctctaaaatagaaaaggcacccacttgggtgcctttgttttattcttcgttagattgcgtttcagacgcgttaaattcggtttcagtacaacttgctaggtaacttatattttgcatcactacaactacaggtgtttgaagtttatcttctagccccgcagccacttgagccaaggcattatcaatatttgatttcctaacgcccgttccatgtcctgttgccaagtaaagattaccttcccctttttgtgtagcattggcaaagtagtaaacgtaatgtgcaaggtagtaatcacggatttcttcagtcattttattctcctaataagaaaggggccgaagccccttgagtggtttatttgtttaagtggtcttcgaccattttaatgaaaccttcattgctgaaggctgttgcagctttttctcggtaaacaaaaactccacgatcttcatagagaagtgtttcttcgtaattaactccagggttaactacaaccatttttgtcccgatgttaagagcaggaaaaagctcccagttaaaattgataacttgattagagcaacccactacaatcaccatatcttgagccgtcaagccgtctaagatgtggtacatatcgttatacaatggggcagtctccccaaagaacactacattgggcttcacatacttgtaatcatccacatcgatagcagcatagccaacatctttgatgattctattgtctacgatcacttcaggcaggaagccgtgaacatgtagaacatcttcatgaacaacaccagcttgttccagaagatcatctacgtttgtcgtgatgttgataacacgatcacagccgtactcttgaaaccattccgcgatctggtaatgcgcagcgttaggagttacactatccatctctacgcgacgtttattgtagaagtcatgagttttacggtagaggttgtatccctctgcatctaatccgccaacagccccaggaacacactgttcttgttggtatccagcacggaagttgaaaatgtcacacacttcagaaaggtcgtattcatcccacaaagctttgccactttctgtgtcagtgcggaaagtacgaacaccgctatcggcgcttaagccagcgccgcttatcactattaatcgtcttggcattcttcctcctcataatcatcataatcttcgtcatccaaatcgtacacttcgtcttgagaataactcacttcaaagtaaatatcaaactccgcaaacaaacgtagaatattggacatgctgtaataattatcgtaggcagattcagcttcatagtaaacataaagcaaatggttagccttatcatcttccaaatatttcccgtctgcatatgcatagtctgcatatgctttacctgcatcttccacaagagaacgatcaagcagagtaggaaatggtttttctttttcttttagtttgctcaccaaccagtgtgcaatatcatgccaatctgcatcctctccgctgaaacagcttgcgacttcgccaaacttggcatctcctaagtctccgctaatagtgatcatggttgaactattgtaaccacaagtttcgcaatttgaacaactgttgtgcacatgaatttctacttgaaacatatttcctcccataaaagaaaagccccctgaaacaggaggctttgttcagatgctggcactataccagactttgtaggtatttgtcaagggcttcttgatcgccttggcaaacatagcaacggaagtcttgagccgaaggttgtttattttcatcccagtcccaataaacattacccttataacgtgaaccaggaaactcaaaagaggctgtatgtgtaatgtatcctgggccaccagtgaaatcacagaatgagaattgagggtatgctgcctttactgcctcaataaaccaagctttacgatctaaagcttcattgatgctatacgcatgtctctccatttcttcccacgttttccagacacttctttcatcaggagaaaagacaagccattctggaaggtagagagtgtcatagtaatcatcatattcgatctcggaggcgcacgaagctgactcctccagttttgagtaatcaaaagcagaatatacccaccaaccatcttccagtaaggctttgacagggacgaagcctttatcagcatattgatcgaattgtttgacacggtggcttgtgcagtcttcaaactcacattctaaacgatatgcaccttttcgacgagcctcaagaccgtgtgtactgaaaataacaacacttccttcaccatcattacgatctacttgataagcaaccagtggttttgaatttgacattatttctccttatctagaagattgttagacaaaaacacggcacgagcaaaaccacgtgcggttagggatctaagttgttttgtttttgcactagctccgcctaagcttttccaaccccagaagcagcctatatgatctactggtttcttcactggttgaacaaaaccattgccgtgccaaatacaagttttctttgtatacccatcacgggtaggcattttaggatgaaagcttccttcctcttcaaacaaatacccaccatattcataaggatcaaagtaaaaatcgggtttacgccataaggttgaaagtttacctactgggttctcaatcatccaaggaacattatatttgttacccaaagcttccactacacgaatattagctaaagcttcatccaattcctctgtgctgcgttcgtgtttgctaccactacctgctaacatagtgcaaggtggaaatccaaaaataatatcgggtttaggtatcccatgatcttcagggctgaatgtagaatctatccaggcattcacataggttatgtttgggtgctccatcctaacctcgtatttaccgtgatccccttcatcagcgtttacacaaaaacacttgtgacctgcttcggcataacgtaacaccatgatcccagatccgtcaaacatagacaaaactgttttactcattacccctccattcaagacaagccataactttacgccaatcactttctgtaagaaaaatctcgtttgctttcttccacaaatctaaatcgtgaagggttggaatacgatatgttagttcacagaatctatgctcttcttctgtaatataaccaaaatgcagagccacatcgtgaaaccaacaccaaccatgcatctctcgaacaacatggtcatgttgagacattattttatgccgtaaacctaaccaacaaggaacagatactttagtagtctttaatctgtgatcaacagtattagagtattcaataatagttgtcagtttcaatcgtgctttttctaaatcctcatgcgtcactttgaaataactttctgaaatatatccacacatattaataacctccttcaaaaggctttactacatgatgattagctttaaaacgttcaacatagtcgttttcgcccatgttttcatatagcttaataacaacataaaagttttcccaagcatattccctaaaccaaccactagtgatggatgtgcagactttagataaagccattataaaactttgcttaggggttggacctccgatctctccaccgaaaggaatttgtgaacgttccaaagccaaaacacacgcttcttcataaacacctaacaggcgcacatgttttggttgagcaaaaaacttttctttgctggtcataacttcacttccatctttcatataagatttatatgccggagcatccattaccgcgattgcttcatggatagaatcatgatcataaacatacggaacctcatcacctttaaaaaagtctttactttttacgtttaagttcggatgagagtaagtgtatgtttctttctcacgcaactcataaatactcttaagattttctgggatctttgcgcccagtgaccgcatgaaatgaatatctttcatagttttaaagaagtgaggactatcctttttaaaacgatgactcattttaagaaggtagagcacatctaaaggagcaacaacatgtccagcgtaagttcgacgaacatcatcagaatcttcacaataactaatcaaagcttctgtgctatctccttgagaagcaatatcgtattccaaatgtgcaccagctatcattttgacatggcctttgtttcctttacgttctacaagttcaacaaactcctcttgagagaacatttttgataattcttcccactcttgttctgtacacaggtaatctaaatctacacaagggcgatacaagtcttttcccatgtccatagcatgaatttgcaatgcacggctaccaattaacaccataatatttctcctctattggttgataggttaagtttatcaagcttccagattcctgtcaataaaaaacccgccgaagcgggttattatttactaacacattgaggaagaagagatccaaacacctcttgtggttaaaccattttcatccaactctacaccataatcttcacaaatgaaatcaatatagtgatctgcggctggcgttcctgtagggtaataagtttctccgttaccgtagtcacctatccaagcttgttcctgaaactgttcacaaagttcttcaatctccttacgaaactttctttgtgcttgttccatctctttaactttcttttttatcagcagttcgccttcagactccacaatctctccttaacagctactactgtgccaaacgccttgagaattaacgacgaaaccatcatcaccttcaccataacaagaagaggattgccaatcttcaaaacagattgcgtcattttctaaactaagaccaaaaccagcatgttcagcttcttttgtaagttcgtccactaaagccataatagcttgggctttttcagttaattcttcaacattacgataactcattagtatttctcctctggttggaaaacggaacgacaggcccacatagaagcttctttcaacttagtctttgctattgaaatttggtcaaggcgggtggatatattggtagactcttccaaatcttcacaatcatccagttcagtccacaattcagacattagagcatcaaagattaagcctaatcgaacttcagcatctttaatagcattcactttaccaattttgtcatcggtatgcggtttataacctttgatatcttcgattcccactttacctcctattaacaacttaaagaagatggatgccaatttgttccagtattctcattttcatcttctggatcataataaccacccatcccatattcaggggagaaactgaaaccttcaccagtctcgtctgctaactgctctgcttctgctaaagcctcataagctgcttttacggcttcttctactgttttaaacttggtcgtcataaaatttctcctctcctaaagacatgttgacatgaaatgcgcggtatgtaaattcgttgtccgttgtgtttgaataaaactcaaattgaacaacaccgtcttgagaagacaaatacatgccaatttgaactgttccttctggtaccaggtaagcatactctggacgtagggttacattgtaaaaataaagttccccaacacccatttcatcccaagcttcccaagcggtaacgaagttactttcaaaacttgttactgatccgaactctgccataaaacctcctcaatcttgtagtttgactccatctccaacacatttccacgaacgtctctccgaagaaaggcgtaagctttattaggtattgtagactcatatttaaccatatctggcacagcaaaagatactactactcctgctgggcttctgtcaagagccttattaatatttctaaggatatcgttagccaagatttctgccaattctccaagaacggtttcggttatatctttatatcccattaagtatttgttgatatctttcatctctgtattgttcagagtataatccaaaggatagaaattcaaagcggagtcacttttatgtgtccacatgaaatgcacccgatccgagcagaatcgtaaccctctttgaagaatatcttctacaacaggcagaatttcttttgtcacatcattaaccatgttgtaatctaagatttctgccaagtttgttctttgttcaccacgtttacgtttaggaatcacttgttattgccctcattaccaaaggtcgtagaaaatcgtaaatctcttgttttgttttcccacgaatgtttaaacaaggaacattattggctttagctatcttccaagccgtagctgttccaccttttgcatctccatgtttatcagtattagcacaagccaacaagaaacaggatggagcaggattttccaaatctctacctaacacttgatgcacattacgttggtgcaattttctagcaccctgcttaagcttttcataggctgggtgaacatctttgatccattgcacagagatagcatagttcattgtatctggttttgcaagaacaataacatcccctggaatctgattacctttgaaattttcccaaggaacataaatctccttgttagtaggattttcagactcttggacacctgtttcaaaagcagaatcactaccctctgccttcccagaccttaatttaaacccaaggtttgaaagccatttccctatgcctaccatcaaagcccactcttcttcggatatgtctctacttccaactcccgtatagaacagttctgccataatcacctcaacaagtaatttcaaaaggtgtatacggttccgtatttctcatgatccaaggactgctaggattgctcggatcataaggaccaaaaggttttatggtcggttgtgtttctttcttctgaatctcttcaaaaatacgacgaagttcagaatattcttgatccaccataagattcggtgcatctgattctacagcttgcaggttatcttccttaagaacaatctcacgaacaagattaacatcttctgtttctaagataacttctttacggatattacctacactttgaataattgtaatcttatacattaatcctcctcaagagttgaataaaattgaagaccaccgtccatatcgaaataagcaaatgttaagttattattgaacacagatccagtatccatataaacacgattcgcattgataataggtgtttttacataagagtgtccatgaaacacataatccacacccatcacaacaggaagtttcattccctctttagcacagtctaccatatctctgtcccacataagtgcttcagcaaaacggttttcctgtgtttttgtcatcttcgaaatgtattctggaatatctgttacagggagatattccaaagaagatggatacccaccatgaataaacgcaagtttcatgcctctgtagttaacaatgagaacaacaggtaaatcttctgtcatcattgctaaggctgtagctccttcttcaccacattcttcaaagaccgtatatcctccattttgataccaacactcgtagtagctacgatctccttccagcatacctttaatcatcatgtcttcatgattgccacgaatagcgtagcgattgtgtttacgagtaaattctaaaacacaacgaaagttttgctttccacggtcagtaagatctcctagagatacaaccacatctgtatctcggatacctaactttgcctttcctttttcatacaaattataacaaccgtgtagatctccaattataaaaagatcttgatcgcttttaacagtaatttctctgtgtatgatcacttatcctcctcaaaatctaagaaaataaaaatattcacctttccttcaatctcttgttctaaaacaagatcggcaaattctgcataagctttctcttcaactttttcaatatgttctgcggcatctttaaaaggcgtatccccatccacctttactaataagaaaagagatcgcatttcgacgtttttactgttacgaggaaggaaatctacagcttcaacaattctccaacccaaatagccaggggttttatgaatctcccctaaatacttttctaagattttacgaccctcgtcgataagggcttgttctgtagtaatttccattccttcctcctcaaattattaacgaaaccgcatgactaaatcttggttcagatataacctctgctacagtcacatatgtatcgtgcagccaaaaagattctactctacaaacacaaataccgttgataatgaaatctacacaggctttattattttcgcacacttgttgactataaacaacccctaaagagtcataaagtgatctcactgttgctaccatttcatctgtttcgtcttcctgtgaaacaaagaaaacgaatacagacaagttattagcgaaagtattgctattctctacttcaaccgacttacaaggtaaaaaggagtaatatttaccgttaggtatcaatttcgcctcaacctggttaagtatgctttgagatggttttgttacataaaaaagattttcagttgggttttcaacattactccttactatgcaacgagtggggttcgaaggatcaaaaacatgatcgaaatcgacacacacaggtaagttaacaactttaaactttttgctaagaatgcttactgctgtaaaaatcaaaccagcatttattttgccagtgaaagttgaacgcataactactcctcggatcattctaccaaagagaattccgcctcttccaggtagattacagaccttgttgcatgatatttaacgctccagaaattaccttcgcgccgtaaaagtatctcattcacatcaagattgcttagaaaaaccatataacttaaagcttgttgacgcgttgagaattgtttctctaaaagttcttctccgctctgcataatccctccttaaaatactccctccgaaaagggagtataagtatatcacgtagttgttatgttgtcttcttggatattagaatccacttctgcaaacatatcttctgcactgtaattatttccagtccagcgtgataaaaggatagcaccaatctcttttgcatgagattcggactccgcataaacgttagtcccagtgtcaccttttttcttttcatgtgcataaatgcagtaataattgtaagccattaatcttcccagtcattgccctcggtagagtgaactaaagctcgcacgataccaccgtaatctactgcctgatttgcagcatgttcggcataaacttcaatggcttttttgaagaaaagagcagtagctgcttcaatattatccatttcgccatctacgtcagtagaaagtgaaaggttgaggctttcatctacttcatcaaaatcaatagccactgtcataattagtttacccatagttcacactccttaaacaaaataaaatggttgagagaggcccaaactattctttgggtcgtatacataccaagcgtatgctgtcttatctgttccacctgcaacaaacgaaggccgttctgaaaggactataaggtttgttggtggattcttttgatggaactctcgtcgtttctttgactccaagaagcccaaccgaagaagataaatacaaacatccgcctcttttaagctcttttccaagaactccattgctaacttaaatggaggatttgtgattataatgtcgggacgattttcccattcatgactaaaataatctttaccttcttcaagttcacaatattctgaaccttcaggaaaatggcgataaatcgcttcagcttcacctttgcaaggttctgcaaaaacccaaccttcttcctttagatttttgaaatctataacactaaacaaactattgattgctttttgcggtgtcggataataatcgctcgttgggcgatcataatctaatgccatctaaaatctcctcttttgtaatattatccaactctttaaaggatgaaatctcgtttaataaccctatttgatcagcctctagaggataagtgtttttatctgtttttctagacagaatatcttcaacaaacttatcaatagctaaagaagaatcataaaattttaaaagttggtaatccataggagatattttgtcatctcttagaaatatttctaacatgttttcaggagtatcgtggtttagtttatgttcaccaaaaatattaacttcgtaaacatctttgccaaaccaacgtttcttcttttcaacagtataggtttttgccaccaaaccatctaaacagtttcttgccctcttacatgtttgacggtaagagtggatagcgccttcaacaaacttagcaggaacttgtaacattattaatctcctatgtttaagaaatgcccccgaaggggcagtttgttaaatagcggttccttcgaaatccgccacatttacgagattaatattttcagatttagaagtcaagttgttttctgcaacagatttttcttcagtatccgcctcgttacctgccacgttacgaggttcttcttcaccgtagggattaccgaatttcaaaagattgatcaattcttctttggagaagttttctaaatcatcgtctgttaattcaataatctcgtcttgttcttcaataaatgtttcaccaccagaaaaagcatctcgctttttagctacttccatagcttgttctggtgttgcccctgcgtcaagagcagctaaagcaaagtctgacccacttcctactgcataatattcttcatcaatcggatatgcacgtgttgggttgttaccttcgtgcaggaaaatacgtccgtctggatgaacaacaagtgcaataaactcttcatcttctttatctggatcagagtgaatcatcaaaccagggacagcatcacgtgctgcttcgcactgtagattttgttcaaaccattgaaagaaagaaagcacggaggtcagacgaccagcaccacctacaaggtaatctccaatttttcggacctttttgaaattaatagaatctacacgtccaccaaaagttaccttaccgtcactcaaaatcttatttttggttgcaataattgtcgtcactattcttcctcctctgttaatgttttaagaaccgctttcccgccattcacatatttgcagatgtattctatcgcacgtagtgtctctttgtcaacaaaaatttgatcagacgttgcgagcgggttattaagaagatcactacaatcacgaacaagcagtgctttcttattaaacaaattacttaagaacagtaacttcgcctcttcttctgttatgtgcagaaggctaggatcgtagccagctattcctattatacaatcaaacaagctttctttactatcagaaagttcttgaaaatggtttaaaagccaatcttctcctagacaccaacatttaaacatttccagtttatctcggagggtcatattctctaaagtaagagcaatctctttttcaatatggtttacacaaatttgacgaaattcgttaggttttacgagtcccgtttgatagcactcatctataccgcttcttccgatagctattgttgctacacccatcaatcctccttataaatggcttccctgccatgttattaaataaacacttcagtaatcagtttagacaaacgtccacgtttattatcgtccgttgtcagttcaacgtatccaataaaatctacaattggctcacgaacaccttcttcattttctggatataaaagttccaaaatttgatgcagaccattgctacgttttttaattgcatatgtctggcgaacatcgcctaatacaataacatgcgtattaatacctgcacgttcaataagaagtttaagtgtttctgttgacataagttgtgcttcgtcaataatgacgattgtattatccagggtggcccccaacaaatagttaggaatattcaattcgatcttacctgatccaatatcgttttccaatttgttggctgtcatgaattgctggaaaatacgttttgtagattcatagtgtgctgctagtttatctgttttatccccagacaagaaaccaatctggtcatctccgacttcagtagggttcttgataaaaagtagtttacggaagtctcctgaacgaagcatctgcaaagctttccataaagcaacagaggttttaccagtccctgccggagcatttacaacagtcagatcattccaaatcatgctttgaacaatcttattttggtccccttcaggcataaattcatctaaacggtaatcgtcattacctaccgcttttgctgcataacggctttcaatctttgctgaattagccagtttctgccgttgtgttttagctgcggttttatttcccatagtagcactccttttagaaggggccgaagcccctttattagttgtaagcatctaaagttccagaagtcagaactttaattactcgttcagcacggtttggcgtctggttataccatcggcttttacgcatgtttttacctgcttgagtataatatgcattgctgattaaagtcaagctattttgaaacccttcagcaccttttaaccccaactggaaaaccatgttgattattcccaatttacgagtatcactcaccttatcatagattggtgataagatagtactgttttttatgtctctcttcacttttgcaacatcgtcagcaaagatttgacgggcttctttttctgtgataactccattagtcttacgaccaagaagattatctaagatttgaatagcctttgctttatcttttattttagtcagaaggtgtcctatgccgactgtccaataaccaagatggtcttgataaacagtaagcttcagtccttcatcgactcgtagcatatcaaactcatctactactttagccatttacttcctattcgtcgtctcctactccgtgatccaactcgttaaacaacagatgttctggagaagtttcacgttttggtttcgttttctttatgttggacttcagctcatttgccaaagcacgagaaaagatcttacgtttctgtttacttttcataattgttactccgcaatttgagccatgagatcacgcagttcggtaaaaccgcctacgtatgttacctccccgttcacttcagacagaatttgtggaaatgtgcgtggaggaactccggtaagatcaacaactgttttagtcattgattctaaatcatagtcttggtcaagacttaaatattcaaactgtttattgcgcatagtcaatagttgttttgacatttcacaaaattgacagttaggtttaccaaaaattacaaattccattacctctccttattaagtaatactgctaaagactgttcaatacctttatttaaatctgattttgtaagatagtgactggttactagttgtgacttcaccggacgtgctgctggagcattataggttgaagctgataccgccgatatcttaacaggttctggcatctgtgtcaagatcttttccgcaaactccgcccaagaaataagatggcttcctgcaaaatggtaagtcttaacagaccttgaccaacctgtttttaatacttcaaaaatagcttctgctaaatctggagcatatgttggacaagagaactgatcagcaacaataataaaatcacgttgtccatcattatagcgagacaacatggtttttagaaagttatttccaaattcactatatacagacgctgttcgaataatatatgcgttcgggttaactcctcgcaccattttttcaccgagttctttcgtatacccataattgtttatcgggttaggtgtagtgtcttcaaaaagaggttgagaagaattaaaaatatagtctgtggaaatatgcacaaaatcaattttaagtttgctgcacactgccgcaatatttgcagggccataggcattaacagccaaagcagtagcaaagtcatgttctgctttatctacagccgtataagcagcgcaattaataacaccatctacataatcttcaataatagcgtttcgcacagcttcaaaatttgtaatatctacacgttctttaggataaattaaagacgcatttgaaggagccactttacgtaaagcttgtcccagttgtccattaccacccaataccagatatgttagcatacaccctcgctacgtagctgttgaaaagacttagccattgcatcttttgttgataagataggtttaaaatcttcgtcaaaaatcatatcgaagccccaatcaatccctatatcaggatcatcccaacgtaaactttgttcgctggaagggtcgtatggagttgtgcatttgtattcgaagatagcatccatactcaacactataaaaccatgtgccaaaccaggtggaagccagaactgtgtatggtgtcgtgcacgaagaacaacaccgtcccaagaaccgtaagtaggactatctttacgtaagtctacagcgaaatccaatacttcaccacttacacaacgaacaagcttaccttgcggattatttgtttgaaagtgcattcctcgcaaaacaccgaagtttgatttagacatgttatcttgaacgaaagtttgtctaccaatgatatcttcgtatttttgttcattatatgtttctaaaaagaaaccacggtcatctttataaacgtctggtttgataattaccgcaccttcaatttttgttttttctactttcattttccctccgctaatttgagtaggtattgcccgtactctgttttcttcagtgagtttccatggtagaccaaagtctctaaagaaatccacccttttttgaaagcaatttcttccaggcacgcaatcttcaatccttgacagttctcaatagtctgcacgaattgaccagcttccatcagactggcgtgtgttcctgtgtcaagccaagtaaatcctcgtccgagaacttctacttgtaacttcctgtcttcgaggtagctgcgattgatatcggtgatctccagttctccacgcgcggaaggggttacttctagtgcgcgttgaacaacagaattatcatagaaatacaaacctgtgacagcataatctgatttaggattttcaggtttctcttcaatagaaatagcttgacgattactcccaaattcaaccacgccgaatcgttcaggatctttcaccaaatacccgaagatacaagctccgccccaaacatctaccatctcactggcgttaatcagtagtttaccaaagctttgtccgaagaataggttgtcacctaaaataagagcaacagagtcttctccgataaaatctttaccaatgatgaaagcctccgcaagacctcgtggctcggattggattgcgtaagtgagttttatcccaaacatagacccatctccgagaagatacttaaagtcttcctgatcgcctggtgtggtgatgattaagatatctttaatgtcagccaacatcaataccgataaagggtagtagatcatgggtttgtcatacacagggagcaattgcttgctcacactgcgtgttaccggatgaaggcgggttccacttcctcccgccaaaataatacctttcataaccctccttaaatcttctcactccaccattgagggttgtttaagtaccattcaatcgttgagtagagatcttgttcaaatgtagagtttgcactccaacccagttcagactctattttagaaggattgatttcataacgcaagtcatgtcctttacgatcttcaacaaaagttatcaagttggaagaaggataggttcctgcttctggatgtacagcatccatgtagtcacaaaccatatagatgatctccatattggttttgggattacgtgttccaatattatacgtttgacctggttctccacctgttgccacttgaagaatagctcgcgcatgatcctcaacaaaaagccagtctcgcacctgatcgcctttaccatacaccggaatctctttattcgtcaagatacttgtgatgatttttgggatcagcttttctggatgttgataaggtccaaagttattggagcagttggttatcacaacaggtaaaccgtaggtacggtaccaagctttcacaagatggtcagatgctgccttagacgcactgtacgggcttgaaggggcataagctgtctcttcggtaaagggaacgccagagtctgccatatcgccgtacacttcgtctgtggagacatgtacgaacatcttaagtttattttttgggaggagccttgcagcttccaataaattgtatgtaccaataatattggagtcgatgaaaactcgtggattcttgatagaattatccacatgactctctgccgctaagtgaatgatgaaatcgggattgcactctactactaaacttttgacctgggtttcgtttgccaaatctgttatgcttagtttaacgtgagtgatatcgcctacattctcaatatctgctgcatagcccatcttatcaacgacaaaaacttcgttattgggatcttgacaaagagagcgcaccacggcactcccaataaaaccaagaccacctgttaccagatagcgcatcagttctccttaccagacatgttgagaaataatagtttccgttttaatgttatatttttcaagtagctttgcataggcttcttttgcattctcattcaattgctcaagatctacagctatgcttccttctccgccttctaaatcaaggccatatatgcaataagactcatccgcatcgtagaaaggagagatgcggcttaagtcaagaccttcttgtaagaaccagttaaaatctccgtcaaattcttcttcaattctaggatcttctcctacagcctcttcccacttattaaaaggtgcaccctgtaacatacgccattcgatatcaatacccatttttcatctcctcctcttcttgagcagctttaataattgcttcataaatatcgtaagcaatgcctccacaacatctagcttcgaaagctattgcttctgcaatgtgatctgttaattctcgtggaatgcgaacatactctttttcactctccatcttctacctccaacccttctttttcaaagactactactcgtccctcaccatgacaattcaggcaaggaaatgttaccataatttccacttccatctgtcccgtcccaccgcacacaggacaaaaaataagtttttcagccactattcctccttaattatttcaaatttggcaacaccatttacaataatatgaccacaagacataactcctagccaaggatcgccgtttttcttcaggcgtttaccgaatacatcacaaaaaccattcttcatttcagaggcttcataagaagcccctttatcaaaaacgtctttgaatgtgtcgattataccaacacatttcaaaatcattcgaagtcaagctcctcatcatcagagagatctttgttagctgaattcaatttgtaattagttaactgaatctcttgggctgctgactgaatcaaatcaggattcaaccatttttccatccaagctaaaggactatgtttaggtgctttaaacttggctttcattttcaatcgacgataaataggagcagcattgaaataaacccactgtttagacaattcggcgttaagacctacaataaaacgaccttcactaaacaggtagtcacaccactgttcctcttgttcaacaacagtgtcgaggatcaaagtcaactcttcaatattatcttcgtaaattttacgccaaattgggtcatgcatcaatgcatcaattacagcatagtccatcttaacatgcaagatttcatctagcataattttctggatcagtttacaagccccaacaaacagttgttgttctgccatagcaaaagtagcagagaaggaagatataaactgaataccttctaatccaatcagggctaccatccctttaagaatcagcaagcgaagttcatcgttagcttcaatcaatcctagagcatacttatgaccagcttcttccaactgacccatgatatcagcaatgatacccatacgattgaaaattttatcattaatcataatctgattgatgacttcaattggatctggagtacattgacggattatttcagaatacgttaacgcatggagaacttccatttcactctgcttcatcatcatagcacaggcttcattgttactcaagaatggagagaacaaagtgatgattgattttgcaagagaatcattttcccattggaacgataagtttttaatcataacatcatagttgtttttagaacaagctacgaaatctttacgtgtctgatccagattaacttcattctcatcccaatcttgtgctttttgaagtttgtagagtttatgcatttctggataagttacgttaacagaatcaaaaatccctaattgttcccctaaaaatactggatattttcctgttttgtaaacttcgttatgtaaattaattgctgccatttaaatcctccactatttcacaaaaaccttttaagtttaaaatatcatgttcctcaacaccattagtccggtagaaaccttctaatgcttgccatacgcttctaccgagtataacagtcactgtttcttcacttcttgcccttgttattgcgtaagccgtagcttctggataaaaagattcccaaatctggatattagctatttgaagtccgccgagataatggtgacaccaaacaagggtaaaatcttcagggggaatcaacaaaggcttaaacccaggacggtagattggggttactccaggtaaaactataagtgtgctcataatctctcctcaataaaaaaggggccgaagcccctgtattgttacatcttgcaagcttcacaaccaccatcagaatcttcttgtgctaaagaatctgctgattttgttctactattaaggtaatacaatgacttaccacccagtctagcaaagttcaaaataaatttcatctcttctttaactgataaacgtccccctaccaatttagaataatccaaccaagaatcacaagaaattccttggtctgtaaacttggtaaagataccatacatttctgcaaggtctttagccggagtatcccaggcggattggtagaacattttcagtttttcgtagtctggaacaataaataatacgctacctttctgactttgtttatacataatagtatcacgaacagggtacagagagttagtagtattgcttaccaaactgctggactcattaggtgcaatagcagccaagacactgttacggataccaccttgttcaatgatttcagcacgtaagccttcccaatccattttaagatcaaaattaccgatactatctactgttttagcataagtgtcaattggtagccaaccttgaggccatttggtcttatcgatccactccgcattacctttttccttagccagacgcagagaggcttttgccaaccaaaagtaatgacgttctgcaagttcatgcattaattttttagcataagcatctgaataatttacaaaattacttgccaagtaatgcgctaagtttgtaatgcctacgccaatagatctacgtgctttagcagttatttcgttatgtttaaatggataatccattgtttcaataacgttgtcaattgtcaatacagtgtagtatgcaacatcctcatattcttcaggcaagacacgaccagcaacaatagaagataagaaacataaagccaactcttgatcttctgtattctcaccagtaaagagatccggcatactatggaaagctttagttggtaagaagatctcttgacacaggtttgattgatacaccgtatccaggaaaggtgtatggttgttaacgttgtcagcaaagaacatgtaaatacgtcctgtttctgcacgttgaacaataatctctgtcagaagatcacgagccttaacaaattttttcttaatgcgacgacggcttactttgtcataaactgcatcaaactcttcttcacttttatacaaagcttcataaagttcaggagcatcatcacaactaactaacatccaatcttcgttttttgctgctcgacgcaagaacgaacggttaacaacaatagaataatccagtttgtctactcgtttatctataggtgttgttggattcttcagtcgaatcagatcgtcgaaatctggttcaagtatagtaaaggtaactgtagcactacctccacggcttgcttgcttcgaagctccaacactatcttccatccatttcagatacggaagaagaccaccatgaataatacgattattcttaacaccttgacctgtggcacgagtttgaagattaacaccaatacctgcgttattcaacgtatactcatgagctaagtaattagcaatagctaaagattctgccgtatcgtctgcacggaataaacaacaagacgcacttcctttgattggagttcgtagagttgtcagatatggtgatggcagattaatcttaagatcactaacataagtataaagttttttaatatcttctatacggcgttcttttggttggatctccataaccttcattgcaataccaatgaaaagaaactgtggcgactcatgtactacatcgttcaccgcatctcgaataagatatttatctaccatttggcgtaaaacagaataaccataagttaggtttttattatgttttacaatcttaccgatttctttgatctcttcatcagtataatccattttagcccaatgtccacgttctaccatatcatgataaaaggtattcagtgaagggatactgtggtatcccccatgagcctgtttgtaaatcatacccagaagaagccttcctgccatatcactgtaagcttgtgttttcttgtcaatacacgctgcaatcattgctttatgcagatcacgtgtagacacaccgtcataacaccgcttcacagcttctaattcaatttcagaccagtttagtttacctgctgcaaattcagaccacttgcgaagtttttctggattaaactcctctgtcttaccgttagatttagttacaaaacgaatcaacttctcctccctattattaatgcatattcaaaacatctacatcataaccgaacttcatttcattaaaaagtccattagcatatagaaaaccttcaaaatgagttatgtcatcaaacccttttgcttttgctcgacggtctgcttcttgtcttttaggagataaacgttttgaagtgtctagaattacagttacattacaaccaacagtttcatcaaaatagacttcgatttcacagccttcatatttattatcagtcattgtccctctcattgattagtatcatctgctttcgcaggatcataagagttaccgaaatcatccatcttaatatgtgacgcaccccaacctgtaaattcttcatcaccaaaatgaaaaatatcattttcttggtagattcgtttaaaaccacaattaggtgaaacagggaaagtgaaaagcgttgtatttgcaaacactactcgcttatcgttattgcttcggatattcacattacgctcaacagaatagtgtgaatcttcagccatacccagcattacaagcgacgctctaataacagcattttgtttctcgtgtgggatattgccattgtgtttatttgattctagtttccagataggggtagacattacagtagacatgcttacggtagcccaagttgtagtatttactaatgacatattttctccttcattttgaatgggaggactcacctcctcccagtattgtgctatattatactaaaactaatactaaagtcaataactatttaaacagatcaccatttagtatgatttgttaaaagttgacgatgttgaatccagcctttgaaattgccagaccaaaacttaccattacgatctacatgggtaatacctggttcccaagagttaaaatcccaaggagcattgataaacaaatcttcaaaacagttctctccgtattgttcgcatgtttcttgcattggggtggcttgatgttcaaacggagaagcatgaaccttgcgcccagttagcaaacgaccatagatatctaaagctttatctttagttgcattcaaacgacgatagctaacctgtgcacaacacgaagctgaaatagctttggcttcttccaaagtaaggacaacaacttctccagattcatcttgaacatagtatccaccaaaaacaaaatgatcgtcaccttctgtgccaatattatcatagaaatggtctacataaggtgtatgccattgccctggtttcagcacttctggtgtagattcttcatactctttgtgcatctctttagccaaagcctcgatagtaggatcggcttctttgtcatcacgtagccaccagaaattttcatattctgttgctgtcagaactgttttaattcgttggaaaggttccagaagacggtttgcaacttgtttgtggtaccctgccaaagagaattcttctgcaaaacgtgctgcactaagcgcggcaagatcccaccactcttgagcagtataacctgcatcaataagagcgtcatgatcaacacctttatcctgcataccaggttggttagccccaaaacgataaggacgagcaggttgatttcgcaccatttcaatcagtgttttaacaggtatagcacggctagaagcagcattacgactgaacaggcggtgagtcatcaattctgaatgaataatacgtggatattctagttcaaaagttacaatctcttttccgtcttcagtgatggaatgcgcaataatactagccgaaatctgttttgtcattttttctccttagtttttaaaattgttcaaagtgttaaaaacatccaaacatgttagccactgatcttctaaacctgtgatcacaacatttggttttttctttagttcttctagatggttatctttataaggcgtattaaaatatattttaaccacttcatctggaaaatatagtaggttatcagccctgtcatctattgctatatcacaaggcaataagtatttttctttcgtagcaaaaaagccgttaccagatcctttgctaaaatcaatcgtatctaacgttcttaaaacatgcttatgtttagaacttaagtgaccaccttttgtcacacttgcgatcaaaagattgctacctttccttgaaacatactttaagaaatctggcatacctggaacaaaacccattgtatcatagagatgaggattatccagaaatccgtaaggatctatattgaactcctccctgaaaccaggaaagtagttggtaagatcatagtctgcattttttgtgaatgtgtctatcttaacaccaagtccactaatcttattcaaccattctaaccaagcaacatctaatggagccacaactaaatcccaatcacatactatctgcataaaacctcctctctcttttagtatagttatcttatactaactttcaatttcctgcaataggattttgactatttgtttgcggcgtttcgctactgtgctttcaggttctattttacgcttcttcaaccaagctttatctttcttagctctacacaaagctattgcttctttttcagctttcgcttcttcaaaagatatgccttgcttgtctgcataagcaagaatagagttgcacaatttacaaaccattcgcaaatcttcttctttcacatagattaaacggaaaacaaaaagaggaatatcatcaaaacattgaagttgttttgctgcgtgaatatgatccacttggaagtctttcattcctcctctatgtccacatatttcgcactcacaattccaaacttgttttggttttccagttttcttgtctatcatcacattgccgtctttatctacgcgatcaactttaaaacgccttgcattgataaccttaattttattagggtgtctcatccatgcttttctaaaacatcctctaagataagtataaaattccgcttgtgttttccagggtgttccttcaccccacattatttttggttcacctgccaatattgctcacctttttagctgtatattcccctggtgggatattgtgtttaaaaaacaaaaggcggtctaaccccgccttgcacattgtttctggaatagtcaaagttagtaaaagtttatcaccttttcggttgaatattttataaacttctcctgctccatattgtttagtattgctcgccactaatacgttccttaagttgtttaatagcttcgattgcatctacataagaagagttatacatgtgtttcagtgctactcgtactaaaggatcttttgtgaagaaatcaataagaagcatagcttgatcatgtttagctgcatttgtcatagatggataattttcacgaaccatatacgtgttattttgcataagggttctttctagttcgatacaatgaatagctttatctaggttaatctgacgttcacctttaatacgtgttgcgtattttgccaatttgcaaaaacaaggtgtgccaccaaccaaataagctagttcaataggttgcattgccatttttgtgtagtgatcaccgtcaacctgattatcaaaagcattagacataattttcctcctgaattcctactgcgccttcttctgggtaatctgtataataagctaccctaccttgatagataacatcaccatcatcattgtagattgctgtatcttcttgaattgttattttaacgtcaagtaaatctgggtctttttcgatggtatagtttaaacctaacatttcaaacagttcgaaaatttcgttacctgttaatgtaatgctcatatttcctccttttattgtggttagcagagtatacactaatatcaaatttttgtcaataaaaaagggagcaataagctccctgattattagattccaataatagttgctgctcgtttatctttggatctggtgtttgctctactacgtgacaaacctccacaagattcacaacgaatgatatcgaaagaacttaccgcagtgtggtattgcttaccagtaacaacgtgaacatgatcactgccgcaacgagaacaacggactttctcatctgggtaataagcggataagttaggatgctgtggaatccacggaaggattttcatatacaaatcacggagtgaaacaacatcgccatcattgtaaatctgcatacgttcaaaagcatcacgatcaccttcacaacatgctttccataaagggaacccctcgttatccagtttttcactttctgtttcaaaatacgctcccatttctttaagagagttggaaggaagtgcaaattgtttcttagctgccttcaatgtatcaacaactacataattagaaggaggagccatatcgtgatatgcaaatcgttggttaatatatgcacggtcaaacttatacccgttgtgtgccacaactacatctgcctcattcagaaggttccaaagatcttggcaaagctcccaatcatctgtatgatcaatatcaaaaagaggataagaagacaagttcttaccttccacttcaccagtatacaagtcagcagaagagtaggatagcaaataacctctgcgaattacctggtctggagaaatgaaggctttgaatcgacggaaagtatatgcaatctctggtgcagtttcaacatcaataattttaataactggttgtttctttttaacgggttcttgtttacttccactgaaacgtgcaaggaaatcatttactgtgctttttcttgttgggctacctaaaacaattgctgcaatattacgagaagacataccctctgcactcatactaaggatatctgctttctgctcttctgttaatctgctcactctgcctcctgttgtgagatgtatgactgaagcatactctcaaatgttgtatcgtcattatcccagcgtttcatgtataccaactggaaaattgtttctatccattcatctgttgtcatatggacttcttctccatcccaagaagtaaaattaacaccatctgggaaccatgagtagtaagtatctttaactgtttggaaaagttctgcttgagttttacaagcagaaagaagattaaaacaagtaatatctccgaacttaatatcaaaatcttgataaggtcggatactatctgttttatctcccattagcatctgatatgctaaccagtaactgccccaacctttaacttctttctttttacctttatctacgatccatatgtcgccaatagactcgtcaataagaattatatctggattcttaaatactccatcctctttgtagaaattaaaaaggatactaggagtatgtaaactatctttatctatagacactacaatataagaaaatttacccgtccttttataatctttataaccttggaaaccatacttctctaactcatcgtcagcctctattacagtaacaacatcaccattgtggaactccacaagataatctttggtttctgaaagctgaagtggtttgatatctaatcgttcagacttatattctacaggcattttgaaggcgtgtctgaaagtttttcctacgccaataactccgcaatatttttctaaacgtagatgttttagaatacctaagacttttgttttagctgcttggaaggtgtgtccgatatcttctggcgggtattgcttatcaataatttcgaactcttcctttgtgaagggacgtttgtttttggaggctctttctgcatttgtatctcctagccaacctccaattttagtcttacttttaccccaaaactctgtcttatttttaaattccttttgagcacctgaagggatgtgcttcgcaatgattgttcttttctctaatgcagacgctgcctggaaagcgatctgatcataatcaattgcagctattgtctcttcgttgacatataaatgaagatcttcaggtttaattaaaatataaccgctaatatttccccctaattattcatcgtcatcctctgttgagaatgttttagtatacggacattgacgacttttcgggattgctataacttcatcttggttagcgttagaatagtagcaatattttgtgttgccattaacttcagaatcagacaagattaaagtaatttgacctgctgctactgtgaaactaaaagctaaaagaacgactgtcagaatctttttcataacgcctcctaaaaagcctacctcattaagtaggtaggcataatatcataactaatcccgcaagtcaagaacttatttaaggattgttgctttggttaaatcttccatcagacctcgaatctcattgaagcacagaaggactgaagcttcaatactaccttcttcgtctgcaaaatatttcggaaaacgtagtttagaaagtttaaactctttatccactacaaaatctacaacaccgtcatattcaagaccgattgcaacaacatctttaccatcttcttttagttctacagctttagactcgtatagagattctttactccaaacaacaacgccctcgctatcctccattttgatataatttccgagagtaatacgatctgcttcgtgattctccagcaattcaccaaaaccttttacaatagcttcttcgtgcacactaaaacctaccgaagggaaagtccccaggacggaacggaggaaagaagtaatctcttctgcaacctttttacttccattaagaacataaagaagattcgtagttttatccaagacaacatagttaaagaaatcttcaggttctgtttcaggcaatagtgcaaattcaatatcttctttcattgctttgactacttctttatcgacataaaactctttaccttcgctctccatgtcctgacgcatttcttctagacgttcattcagaatacgtttaactttctttttatctaccttcttcacagattgacctacattaagcagttcaagatctgaaaactcttttacaaatttagagtcatcttcgaaacgaacaagaccgatagtgtgtgactgggagccttctgctgttacgaattccagaggaatatctgtaatgctgttaagggatgctacagaagcattgtcaccaacaaccataggcagagcggatttaaaagattttacaaacatgtttcctcctatttaatacatctcacattaccgcccataaagggcggcttacaacattacttattaataatacctgcaatattaggtttgacaaaggtcgatggtttcatgatcttacctttatcatcaaagaacacatacactttctgtttttcattataaacagcatgaacaccagtgtatgccccttctggacgattggcatttcgttcttcaattgcagcgcattcttgtgcaatggctgaatcgatatccgaagttttccaagttttcagcaactgttgtttagttggatacttggaatcattacttttcaatacctctttaataactttcttttctgggtattttgaacggattagagtgtcacgagacatacgcataataccagcagccattagtgccatttgaactggctctgtaaatgtttgttccaaagcatcaaaatcagtatacacagttggagtaaaaacatcgcctacagcatagtccaagaaattcatcgtatgttcttcaccaaagaacatgtaggtcagataactggatactacaaaaatatccgctgctgcatccaagagttctacatgatcgtttactttcgcggctgtttcatactctttaagctcttcacgaacgaatccgatttgggacataaatagctcttgagtgaattcaggttgttcaccacctcgtgctttagcattccaatcaatcacgtgcttcgctgcatttttgaaaaattcagtatcgaacttaatatctttaaaaaaattctcgatcattataactccttatttaaaatagctttctagaaagttgctaatatttactacagtctcacccatgtaaattcctgcgaaaccgaaaacaagcatacgtggaatattgaaataccatttatccgctggaaaagatgccagaattacaatagcaattgctatcagcatcataagaattgttgctaaaattatcataaaaatgcctccaggtattttacacaatgataagctaagaacatttttccaccttattctgctggttcccaagtgcctgggatcatttctcgaatacgaacaccaacaggttttgttggaataccttcatctgaaaattcttcatactctatttcaacgaactgattaatcaaggtagaagcattctctgctttacgataattggtagtctcatgagcatctttacgcattaagaattcgactactttactattttccatctcacctgtcaacactccatcaccatttttatcactttttgaatttattactttaacttcaagcgtatgacgaggcttacgtttaataacatcataagaacgtttatcaaattcgtaaactccgtgagcattacgatatactacaccttcagctttctcaagtaaagctttttcatagaaagcatcaaactgttcttggttttcaatatactctgtatgaactacacaaataagctcatcaagaccataatcctccactactgccttaagagcagtaagaacatcaacacgtttttcaaacggtagatctggaactggaatatcgtatacgtaatagttcagcaaaggtgtatttgcattatgcttcttccaggcactgttaatttgttgtagactaaggacacctaacccagcaaacacttcaccatcaagaggatgaccaacaacttcactaataaagtttggaatacctttccaatgaggtggcaggttgtacacttccccagcttttgataaacactctcctttcatgttaatcatagaacgtaacccgttcagtttgtattgtgcataaccagggaacacaaccctttcaggataatctttataatcctggcatttcattggtgtggaaggaacatggttttcagcttcttcttttgttttataatagccattctttaactgttttgtccatttggcaaaagcttcaagttcagcttgttcttccggtgttgtttcattggaacgaccaatgttttttgcttctgctgtataagatttttctgtgatttttccacctacccttccatgagctacagtaacaactgcaccatctgtatacactgtccactgtttaagttttccttttgaatctttaccatacagcgtttgatttgtttgttgcattagtcctcccatttaaaaactgaaattttcaatctgttacacacttcatccaaatctgcgtcgagtaacgttgtagatgttgccaacatataatcaatgcttgtgaaaccttgccctttggcatagtcaagcatatcttcatacatatcttcaagatcaccgtcatcaaaagtagctagaaaatcctcgtccccgctacgaacataaaatgcagtactcattcatcttcatcccaagattcaaaagcacaacaatcatcggtttctataataccaacacgtccacaggtattgcaagtgattttatcaccgtagaataaataatttttatcaccttctgtgtttacagttatgtcattactaccacaaggacaagtcagccaatcaacaacgatatcttttttcataattcctccttaagcattcagttcgctgttgagttcatatatctcttcttgaagagaatcgatctcttcctccaaacgggagatctcttcttttagatataccatttcggattctttctcttctaactcattttcaaattttactttattcgcctcattttcataatgcagttcagcgtaatcatcacgcatttgttcaataagatgaatcagagataagatatagttatccccagtttcatcacgccactcttcaccgtgacggagaacggtaattcgtccagtatcttcgtctaaaattgtctcatatttacgatcatctgtataaatttgcattatctctccttattgaagtttaagtgaaccacgaagacgtttctcttgttgatcacgaatatgttgtggaacctcgtgaattgaatcgttaccgtgcctattttcaacaactaaagagataacttgataaccaaactcttcagcaagagttaaataaggtttaagttctttctctgtggttgaagtgttagaaacaataatctttttaagatcagatttcatagcatcacgaacaatactctgacaccacgcgtgtgctttacctacgttttctggcttccaatcgtaaacaccactttctgtgtaatgatattgatctgcctcacagataggccaataaccttcagaaataatttctgctaccgtagatttaccagcacctgaaacgccacgtaaaatgataagttgtttcatttatcctccaatgaagttttcgattttttcacgtcgctcttgctgatttaaagcagcccattgagtcttcgtaaaattatttcgaatccattctaacaaagcgtaatattcttcgtcaacaatttgtttggcattttttggattatcccaaatcagatcccactttttatctccaccacgcataagaaacttcttagtaagatagtgtggtgatttaatttttaaaagtaagttgaacggatagtttgtttcacgaactacaaacccttcgtgtttacaatgtttagacatttcaacaacatctgaaaacttaaccatcgaatgaacttcaggacgcttaaatttggtgacagaagcaattccatcaagagcaccttcaggtaacataaaacttgtcccatcaggattttgaattctggcaccaattaagtatgcacctggttcttcttcaacaatatgcggatcagaaggatcgcagatttcaaaaaggaaagttgcttttgcactctctgtccatttgatgaaatgttctatgtcatcacactctgaaacaatatgattctttgcaatacttgcaaaatctgattcaaggcttcctgttgtcgatacaataagttgacctttatatacacctacagaggccataaaaccatttactttacgaaccacatctacaagttcatccgctggtagatctgtgccattctcaaaacgattaaaaatcttagtgaaaggccaaataacaacattgtcatcagcatcaacaacgattccgcgacattctagaagacgagaatcaatgctccataagttatcccagaaaactttgttcttatacttaagaacagatagaccagaatactctccttctttatatgttttcttatgaactaaacctttttcaaccaaatcgtcgcaattaaatttagtcacattactctcctttgattattttgtgatggtctacagtcacgatatctcgtttactcatcatagaaattatctcatcaaaatgcaagatttttccgtgtgcatcccaacccacatctaacattttaccataagcttcatcagggaaagatccgtgggaatgcccgtgtagcatgattgatccacgaccttgtttattccaggaggccatagggtaatggcttaagacgaagaacagcttctgatatttcacttcgtcataatacaccacttcgccatactctgcaagcacttctcggtgtttactgtagtcatggttcccaacacagtaggtgatatctccttggagacgggaagcaattttacgggtatcttcttcagttccaaaacagaagtcgcccaaatgccacatcttaacaccaggggtagtagcgcatttgttccatgcttcgatcaaggcttctgtcatgtggtccatatcttcccacggacgatattcaggagcaaactctcgaatacgtttatgcataaaatgcaaatcacttgtaataaacattagtataatccctcgctaaataggtcacgatcatgaccattacgttcgtagtcaatctggtctgcgtgttttgcaataatgtatgcatcttcacgactccaccaattgtagtattgatcaataaaaccttgattgtttggaagacaatgcactttatcaagaacacctgcttctttcaatacattcaattgtgcagataatacaggatttgcatgtcgaacacaaggaataattaactcttcaccattattcaaaatatatttattcgcagcacagacgataacacgttgcgcataatgaccctcaccaatccaggtaagaggttggtaacaaatattgttttcaataccactcattgtttcctaatcctcctctcttaagttatcctcgataaaactagtatctggaagtaaaagatcattccttgtgtcgggccaatcctcttcttctcggtagataaagtaaccttcgtcctcttcttgttccgaccaaaccgaatgatgcatgttctctccttaatagtgcacacgaatcattttaataccataacgaagcattgattcttttgcaagcatgaatttatccccagcggcgggattagaagtatgcacgaaaatggtaggtgaaccaaagcaaggtttaccaaacgccagaagttcttccaggtacaggaaaacatcatatccatcttggtctgactccatacctaaatcattgtcaaaagaccactcggttactcttcgatacagtttagcaggatcattgagaaaagccatagcttcttgtgacgttttaaaccaaattgcatcttcctgtccatagtcggctgggttccgcatatcatctatccaaactttcatataacctcctctaagctggcatgattaaaaaagaactctccacttcaaaatgccaatcatctacaagccctgattcccaatccttctcttcatggaaagagcaaatccaacggtacatacctggcggtgtattctcaacatcttctggcaacccataatccaaagctgtcttaccgttctctgtaaaaccaggatggagattaggagctttcagtacagaaaccatgcctccaacatccacagctacgatccactctgtcatgtatgggctgtcatattgaggctcatcataacctacctcaacagcctctgtgcgtaagatgataataggctgctctgtgattggggctttgacaatatacccgtggtcctcaaaaagatcgataacctcgaactcatcgccgttttcgataccatagctcttattcaaagagataaacttcgggttatcatcgtaagctttagttactttaattttcatttttcctccttcactttaacctcaaattctacaggcttaccctcaatgtaaaaacactgatactctgccttatcatcctcatcacgaggccaagttaccaaagagttatagcaatcttctggtgctttgaagatggttttagtctccacagtaacactcccattaagtgttgccaataccacccagctacagggatcatagtgcctccactttccacgttttaccattatcaaccaaggtctttgctacagcatactccttcccattaacaaggaaataataaacgataaaagatttcccgattgttactgtcttagtaacctctacgcgtttaacaccttgcatgtatttcgccttaccggaataaagtaaaatcattttgcattcctcttattgttgataacatccatagcagtatatggtttattagtgccatgatactccagaatcattggagagccttcttgcactacttcaaaaataccataaacagaactttcagcaaataccatttgcttcgtgccttcatcgtttacaacgagagaaaacttcttgcctgtcccgttgaggatctcgtatttcttgccagcagtgaataatccagagtaccactcattatctgttgcttttacacacttcaggaaagtcttgatcatttctttttgctcctctttttagatttctcatacaaacctaacacagccgcttcttttgcacaagtaggaactgaagtcattcctcttcgttttgcttctggtagttgcaaagtccatattccccaccaataaatttggtctgccgtgagtggttcagccattggatctgcctcctgctcctcaagacgttgcaacgcttcttcaatcttctcgattggtgtgtcaaagacgaatgcctccgtatcaaatttatctttcttaggaactgatttggctactttgagaacctcgtttttcggtttcttagtaacgttctttggctttgataacttcttcggtgttttcgccacttactacctccatacgatctaaaaagtcattcacaaatctccagtaacgttgacctgttctaagatcttcatagataaccacaggatcaaacactttagatattccggcaggttttggaaattccactactgtatataaaccaccttttgctacacaagaataggttacgcctgtaattggatagttgctcatttctttacgtactccatgattggggtatggtcgccagtaagcgtaacacggctgtaggacacatcttgtgtcttcagtgtatcaatccactctaagaagtgttctttcgcttctgtgtagttctgtgtgcctttaacaacgtgtataccatctagagttacacggaataccatttgaataacgtctttcatttcttacctcctttgttgtcaaaataacttaccagaacatcgtgaaccacacacatggcaaaaatcagaacaattgttgtcaggactggattttcactaattagtgctatcatctttaaccacctccaattgcctttcgagtttgactttgtttgagaactgataatgacacaacttacattgcatgtcaacaatctgatcgtgatttaaccctacaattttaacttcctttgcaccatcccattccaaatactcaaagccatccaaatgattactcttgtacaacaagaatgctatctgctgccattcaatctgaatgtcatttaaatgatatgctgcacagaagatatcctcgtagtaaaagacgatcattgtcattgcttcgtccagcacaactacctcttgtcttgtaaatctcattctagcctcctaaacgcgtctctgacgcactttttatatataagatgataaatcaccttacttagtaagtaaacttgctctacgagcctcttatgaagcttatgtcatagattatactattgctacctgtttaagcaaggtttttgcacacagaaaataatttttaataaaactcttgacttttgttttcgaagtatgctaccctagaaatctattaacgagcgcagcgagttaaggtttttaggttgttgatgtagtactctgtactcaagtactgtactccgtactagattaataataaataattattagatctaacaaacaggtacagtgtatcagaactggtacgtacagatcaacttctatcaattaaaaaataaaataataaattattataaataatacttgatctatagattagtatgaagtacagtacggaacatcttaacaagaatggaggtgtgcaatgattagtgagaatccgtgcaaatggcatcatgtgcctattaaagattgtatgtcttgtaatccacgttctatttataacattgcatcttatgatgatgacaatgtgttagacgatgatgaaggctgggaggatttagattggactggttatgaaaccaaaaaggataaaattattcctagttgacttaagatatccttcgtgctaaactagaagtgaggagatgccgatcactccccatttggggttcgaaggatatatgcaaaatagtttttattttaggtgccgtgcttgtaataggcatttgacaaaccactccagacgtgataaaaatggagtcatcaaggaatcagacctctgttctatttgcacaggtttggcttttgatgatagtcccgaaagggtttatcagcatcaatgtataacagacgttctcgtgtcaaacttggtagaggacgaacaactaacagattaggaggaacaatgtctctattagaaaaacacgtgtttgaagatggtaacggcaatgcagtttttcttttccatccagaaaaatacacatctgaaaacaatggtacaacttctattgtaatcactaaagatgttaaagttattgatttcttggctctgatgcgagaaatggatcttgaaattaatacttttaacgcagaagctttggttgttgctcttctggaaaagaaagatagtgaagaagtagcagaatatgcttaaataactattgacaaacgtatccttcgtatgttaggatacgttcatcaagtgtggtaagagggtcgttgacttttgttaagatgggcttgcactgcggtagtgttagagactacttcttcagaggttagctaccaaagaggaaaaggaatagtctcggctcaagaacttttacgctgaaagttgggcttggtcttagagaatgtagcggttctctacaatcgtcagcgtctctgttaccacatttatggccctgtagctcaatgggagagctgtcggctcataaccgataggtagctggatcgaaaccagccagggccaccaacgtctttatggtgtaatggatagcacaggagtcttctaaactcttagtcaaggttcgattccttgtaaagacaccagaacattttaacatgaattagctcaagtgatttgaacccactactgatcatggtggcagagaatgaggcaagtatgtcagacattataaacaaaggccacggttatattagaagacataaatgctcgaagagcaccgttcgtggagaacgggggttggtggagtcaccattcatggtaaaatgttttaaaaaactattgacaacaagtattattttatgttagattataagtatggaagggcaaatcgacgtggcgacgaaaacggtcttgaaaaccgccgagctttaaagagccttgggagttcgactctccctccttccgccaggttaggtagattggtgaaatggtagccacgacagtttgctaaactgtagtcggaaacggcgtgtaggttcgagtcctacatctaccgccaagttctttttaatgtagcttactttagcagagtaaatcttcggcaagtggcggtaaccactttaccgataactcatagttagtggtgcgaacactggctattttaaaaagaatttaaatactagcatttaggtgagttaattccgtaggggtagcggggcagactgtaaatctgttatcattgcgattcgggtggttcgactccatcactcaccaccaaattaagatgagttggctgaatggtttaagcggcggactgttaatccgtgttcgaaagaacgatataggttcgaatcctatactcatcgccagaattatggacttgtagagttaaggtaaacccccagtcgccaagaggcttctggaattgcaggtatcgaatcctgccgagtcccagctttgctcctatagtataatggctattacaacggttttgtaatccgtggatctctgttcgattcagtgtgggagcaccaacacaacattaagagcactgtgattgatcgtcgtatcctgtgcacaaggtctgctcgaaagacagtgttcttagtattgtgttgatcacaaaaagagttacccgaaacttgaccggagtagggttggatgggcaaaagaagaagcggctctcccatcgacagcaacgaagaataatatttgactttggttttgtattattttaagttagcttaccgaacgtagggctagtcacccaaagggatactcgtcactgtcccacctattaaataactattgacattcgatagtaaaatgtagtatagtaaatatatacgaagcgttattagtgttagcggttcagcatcccgtccttccaagtcagtggcatcggttcgaatccgatataacgctccaaattatttaataaagggttgccagaaaactttctcttttactcatggttttctccttctctcacacctcttctggttgcccttcattaaatgatttattggtttgtagtgtagtccggtagcacacgacactttgactgtcgtaggtttggttcaaatccagacagaccagccatataacggaatttagctcagtttggtagagtgtacgctttgggagcgtattgtcgcaggttcgaatcctgcaattccgaccaattaaatatttcatgcgtcagacaaaaggttagtctgtatcagacgtgagatattcttttaaatgtttcgtagttcaatggtagaacccacgactgataatcgtgagacacaagttcgattcttgtcgaaacaaccagtttcccgttagacttacaggataagagttccacagcttattgtgatgctggttcgaatccagcacgggatacataatagcgggatagaggagtctggtcgtcctcgccagtttcatatgctggagatcattggttcaaatccaattcccgcctccaaatatcgcttgccagcggtatctttgaagaccttgcctggttccttctaagatggaggggtgcgactccttaacgcacaattataataaagcatttcaaattaacagtatttattagcctccttattggaggctttttgctatctattgaataaaacttgacttattattttttatatgttaagataaagtttaggaggattttatt

SEQ ID NO: 32 - protein, 300 aa, synthetic construct
MKEYTAGAGTQLAVFPLDVINVTQGENGGYSHMGALAIDFSDGTPHKPYYAPFDCECVYTDSYSGVAWQSQKPVKCVDGSVTYVTLLCVHDNNWASNKVGDKKAKGEVIGHSGTAGQASGDHAHFEVSKGKWQGWSTSSAGVYFIKNPSHLYDVFSIKNNVTGKTTKIMNGGGYNWRSIDWDDKSGSGSGPEPSKPTPSKPSNNKNKEGVATMYCLYERPINSKTGVLEWNGDAWTVMFCNGVNCRRVSHPDEMKVIEDIYRKNNGKDIPFYSQKEWNKNAPWYNRLETVCPVVGITKKS

SEQ ID NO: 33 - DNA, 42146 bp, synthetic construct
  source 1..42146: mol_type = other DNA
atgagtattcagctatcggcccctcaggcattgtttctgaattgcgataacaaatacaaagcctatgtcggcggtttcggcagcggcaagacatttgtcggctgccttgacctgcttacgtttatgctcaagcatccaggtacgcgcctgggttacttcggcccgacatacccggctatccgtgacatcttctacccgacatttgaggaagcggctaacctgctcggccttgatgtgctggttaaatctggcgacaaagaagtcgtggttactcgcggtaagacggtgctcggtacagttatctgccgttctatggataacccaggctcgatagtcggcttcaaaatcgctgctgcggtcgtggatgagcttgatgtattgagccgtgagaaagctgagctggcgtggaacaaaatagtcgcccgtatgcgtctggttatccccggcgtaactaaccacatctctgtcaccacgacaccggaagggttcaagttcgtctacgccaagttcaaagagaacccgacgccgagttactcgatggtgcaggcatccacacacgagaatgcgcggttcctgccaccggattacatcagctcgctgaccgagacttatccggcgcagttgattaacgcgtatctgaatggtgagttcgtcaaccttacctccggcagcgtgtattacgcatatgaccgccgtaagcaccgcagcaaagaggtaattcaaccgggcgacacgttgtacatcgggcaggacttcaacgttacgaagaacgcaagcgccgtgtatgtgcaacgtaaagacggctggcacgcggtggcagaactgaaaggtctgtttgatacgccggacaccgtgcgtgtaattactgagaagtggaagtcgcagggccaccgcatagtcgtttacccggacgccagcggcaagaaccgcaagaccaactcggcgtcaatctcagatattgcgttactccagcaggccggtttcgatgttcgcgctaaatccgccaaccctccggttaaagaccgtgttttagccgtgaataccgcactggaaaaaggtaagctgtgggttaatgaccacttatgccccgagatagcaaagacgctggaacagcaggcatacgacgacaacggagagccagctaaagacggcatcattgaccatatggcggatgctctcggctatcctgtagtttacgagatgccggtggttaaaccagtaatcaacatcccggtgactttcgcactttaagaggacaacaaatggtttccgcaaacattaacgcagggcaagggcagaacgttaaaacccgccaccgccagtacgaagagtatttccctaagtggcagaaggtgcgacatgcgctttctggcgacctgacatcgtatctacgtgacgtcagtaagaacgagccggacccggtttacggtcgccagcgtcaggctgaatacgaagcgggggcaatttgctacaacttcaccaagcgaacgctttcaggcatggtcggcagcgtaatgcgcaaagaccccgagatgattattccgtctcagatggaatacctgaccactaactgtgacgggtcgggcgttggcctgtggcagcacgcacaggatactctgtatgagattgatgctgttggtcgcggtggtttgctggttgacgcccccgcggtagaagtagctaccatggcagagcaaaacgagggtttactaaacccaacaatcgctttctacaccgcagagaatatcatcaactggcgtctccagcgcgtcgggtctgttaatcgtgtggttatggttgtattgcgtgaggaatacgagtacaccgatggcgcggatgagttcagccccaactacggcgagcaataccgcgtccttgatattttcgaaggccagtatcgccagcgtctgtaccgctttaaccagaaaggtgcactgatggaaggtggctatatcgaaatattcccgaaactcggtaatattccggtcggggtgattccgttcacattcattggtgcagggaataacgactcaacccctgacgatgcacctttgctgccgttggctgaacttaatatcgggcacttccgcaacagcgcggacaatgaggagtccagcttcgtcgtaggccagcctactctgttcatcgcccccggtgagaacatgagcatgggacaatggaaagaagccaaccctcacggagtgcgtatggggtcacgttccggccataacatcggttacggcggcaatgcgtttctggtccaggccggtgagaacaacctagccaagcagaacatgttggataaagagaaccaggcaatccagattggtgcacagcttattaccccgacgcagcaaatcaccgcggaatcggcacgcctgcaacgtggtgccgacacgtccgttatggcgacaattgcacgtaacgtaagcatggcgtataccgatgcgctgaagtgggttgctggtatgcttgggcttagtgacggcactgaaattgagttcaaacttaacatggagttcttcctgcaaccaatgaccgcccaggaccgcgctcagtggatggcggatattaacgcgggcctgttaccggctaccgcttactatgctgcgttgcgtaaggcgggggtaactgactggacagacgaggacattcagaacgctatcgaggatgcgccgctgccgttaggtgctgttactcaggtggcgggggagattccgcagtcggcgcagcaacaggacaccactcagccgtaagttcacatatagccccgaaaggggctttcttatagtatgctattaactttagtaccacagggtttaactatgagcttacttacatccctcatcagccatcagatatggctgcaacgcaccgcatccggtgaggtgaaagacctcgcaccgttcattcaggagatgcgggatgaaatcaaacggcaggtgctgttattcggcgacgacgggcgaagcactgcgcggctgaataaactgttacgggaccttgaagaagcactgacagggattacaggtgactggcaaacaaagctgacagaagacctcaaggaactggcggcgtatgaggctgagtggaacgtaaagacactgaccgccaacgtagctgcggaatttgttacgcctaccgctgaacaggtgtgggctgctgccgagtttcaaccgttatcgttgagcgacaagcctgttgacttcactaagctgatgtcaggttggggtgaaacggaagtagcacgtcttgtaaccggcgttaagatgggctttgtacaaggtcaaacaacacggcagattgttaagaatgtagtaggcgccggtgggcgggctgacatctctgagcgtaacgccgctaccgtcatccgcaccgcgctgtctcacgtgtccaacgaagcccgtaacgagacgtaccgccagaacgacgacatcatcgagaagtacgagtgggtgtcaacgcttgacagccgcaccagtacgatttgcagggtcagagacgggatgacgtgggaaattggtaaggggccgatgccccctgcccatccgaactgccggtcgtgcacggctccggtaatcagttccgagttcgacttcctcgataaaggcgcaaaacgcgcggctaaaggcgcggaaggtggcactcaggtaagcgtagacaccacttactacgagttccttaaacaacaaccggcgtggtttcaggaccaggcgcttggtcctgttcgcggtaagattttccgcaacagcggtatatcaccggaagagtttcgcgtaatatctgtagatggtttcgggaatccgctcacgcttaagcagatggcggaactcgataaacgtgttgctgattatctgaaaggggaataatgatgggctttttcaaagtaactgacgtaccgtctcgtcgcgtagtccagtacgcccgcgtgtctggctctggcgagaacgtggtgtttattgaagacgaaagtgtactcggaacaccagtggacgatatgccgtttgcggacaagaccggtattgcgctgccagcggcaggtatgctttacgagattccgtacctggcggatgctggtgatgtgtatttctccgtacaaccgcaggacgctgaactggcagacggcagcgcaaatatcgctgtcgaagttaaggcgggcaaagcaccatatgcgctgacctggtacaaagacgggaaggaagtggtaaacgccccggaagaggctctgtctctgacggttaacgcagttggtgaatacttcgttaaagtcactgatgccgatggtatagaggccgtaagtaaagcagcgaaggttactaagccagaataaactgaagccccgaaaggggctttttagtgcctgtgattattccagttattccactcaattgtaaatgttgtaataaactattcgaatagttgacttttcaccaaaaatgtgctaagctccacctgagcttgtgaagtatgaacaagcgaccgcggcgcgggcaggtaacggagcgggacgtaagtcctgagtgtagttacgctgacgcgttcggaagggccatactctattgcttgtgtaaaaagtaactggtttactgagattacgccgtttctatgtttaaatgataaggtctagcgccccgctttaaggcggggctttacttatcgagaaaggggaaacatgaatcttaaagcaactgtcgtagcgggagcatgtttcatcatcctggcttacgcacacggcatctaccagtatcgcagcggctggaacggaggccgggcgaatctcgtttcgcagcaacagcagaaagcacaggctgagttagctaagaaaacacaacggcagcagcaggatgaatcgaaggccgccgccgctgataacgaaggcaagacgaaatcagaggtaatcacccgtgaagtcgttaagtacattaaaacgcctggccgcagtgtgtgcacttttgaccctgagcgcgtgcagctcaagtcccgcgccgtcgcaaacgccaattccatccccggatacgacgatgatgcagccgccgtgcaaactggcactgccaagtaacgacgcggacgaggatttagctattgacgtccagaacacagaatgtgtacggcaactgagacttaaagtgttcatgttgcgggattacgtgaggaatattctggaatagttgccttgtatgttggaataatttattcttgacatgtaaatccgggtggcccggattccaacgtccaggggacatactgatgagcgaagaagtgaaagacgaaactatcgaacaacaagagactaagaccacgtttaccaaagaagaagttgacgcgctggtatccggtcttaaagctaacaacgagaaactcttgtctgaaaagaaagctgccgccgctgccgcgaaagaagccgcagatgcgaagctgaaagccgaacaggaacgcgcaaaacagaacggcgaacttgaggcattcgagaaaacgttgcgcagtcagtatgagccagtactcgccgataaagacggtaagattagcaaaatggctgagcgtatcctcggcgcggaacgtaaatcagttatcagccagttgtctggaatgttgattgatgagagcgcagcggatattatcgctatgatggtcaagaccgaatttgacggcgatgacgttgtgaccaagttcacaggtgcagacggtaatgtcatcaccaccgacgcagagcaatttaaaaagtatctgcgtgagcacaaagcattttcgcatctgattaaagcagatgcagcaaccggcggcggggcttccggtaacaaaaattctactggcggggccggtggtgcggacgtaatccagcaaaaacttaacgccaaatacggcaaacgaggataacagaatatgtctctgtcagatatgaaggtttataacgacgatatcgtcggtaccactatcgaactgcttggtcagaaaactgaccagtttaacgcagcctccggtggtgcaattgtactgtctaccgcttcatggcgcggtgacttctcccgtgagtctttctttaaccagattgcctccgctaaacgccgcgttgaccgttacgccgctatcgcgtctcaggcagctaccgcgctgactcagggcgagcatgtaggcgttaaagtcgctggcggcttcggaccggtactgttcgagcctgcgcaaatgacttggcttaacgaagacccggcaagcgcgattcgtgctatttccgaaggcttctctgacgcactgttagcggaccagctcaacaccgctgttggcgcagctgttgctgcggtatctggtcaggccgcgctggttaacgacgtatctgcaaccgctggcttgtccctgaacgtgctgaacaacagccacgctaaattcggcgaccagtctcagctgctgattaccgacatcatgactggtgctgcttatcacacgctggtagataaagcgctgactaacgcaaaccagctgttcgttgccggtaacgttatggttgtcgatgttctcggcaagcgttacgtaatctctgacattcctgcgctgtacggggccggtactccgaacaagactaaggtcctgtccgtagttgcaaacggcatcatcgttgataatgcttctgatattatcagcaacattgataccagcaacggtaacacccgcatccagaccacctggcaggcggattacagcttcggcctgaaactgaaaggctatagctgggatgtcgccaacggcggtaaatctccgctggacgcagaactgttcaccgcgaccaactgggacaaagctgttgccgagaacaagcacaccctcggtactctggcaatcgccgacgcggacaagtaaagtacgaggaggtaaatatatatgaaagaatacaccgctggtgctggtacccagctggctgttttcccgctggacgttatcaacgttacccagggtgaaaacggtggttactctcacatgggtgctctggctatcgacttctctgacggtaccccgcacaaaccgtactacgctccgtttgactgcgaatgcgtatacaccgacagctactctggtgttgcttggcagtctcagaaaccggttaaatgcgttgacggttctgttacctacgttaccctgctgtgcgttcacgacaacaactgggcttctaacaaagttggtgacaaaaaagctaaaggtgaagttatcggtcactctggtaccgctggtcaggcttctggtgaccacgctcacttcgaagtttctaaaggtaaatggcagggttggtctacctcttctgctggtgtttacttcatcaaaaacccgtctcacctgtacgacgttttctctatcaaaaacaacgttaccggtaaaaccaccaaaatcatgaacggtggtggttacaactggcgttctatcgactgggacgacaaatctggttctggttctggtccggaaccgtctaaaccgaccccgtctaaaccgtctaacaacaaaaacaaagaaggtgttgctaccatgtactgcctgtacgaacgtccgatcaactctaaaaccggtgttctggaatggaacggtgacgcttggaccgttatgttctgcaacggtgttaactgccgtcgtgtttctcacccggacgaaatgaaagttatcgaagacatctaccgtaaaaacaacggtaaagacatcccgttctactctcagaaagaatggaacaaaaacgctccgtggtacaaccgtctggaaaccgtttgcccggttgttggtatcaccaaaaaatcttaatacggttggagtaaaaacaaaggggctacggcccctttttactaggagaaattaaagtggaaattaaatacgtaccaatgccaattaccgttgagcagaagcgagaatataaccgtcaggggttccgtgtggtagatgctcgtttcgcgccagaaggtgccgtggtagaatcgactaaagaagagacaccacgccgccagcgccgggcgaaatcagaggaataatttatgccgctaatcgtggaagacgggtcgatagtacctaacgctgacagttacgttagtctggctgacgcccgcgcgttagcggctaattacggtcttgggttaccggcagacgataccgccgcagaggtggccctgcgcaacggcgctacttatgttgggcttgcggaacctcagatgtgcgggcgtcgcgtatccgctgaacagtctctggcgtacccacgtacaggaacaacactaaacggcttcaccgtagcggataatgttatcccgtcgcagttaatccgggcacaagtaatcgctgcgattacgtatggtgcgggtactgatgttcgggctaactcagatgggcgttccgtgcagactgagcgtgttgagggtgcggtaacagtgacctacttcaacaacggcagcagtggtgctacgaccgcgattaccgctgcggacgacgccttacgcccgttactgtgtggtggtcttaacaatggcttctcgtttaatgtgtaccggggttaaaaatggcgaagactaaatctgagatatttacccttatagggcaggagttacccgacaacacgacggggcttatcactccggccaagctgcgcggtgttcttacgcagagggctgactcacctatttacgccactcctggcgttaaagaggttgaagttctccgtgccgcgtccactgtaatacaagcaccatccgcagtgggcacagcattgcagttaactttcggtcccgcgcatggtagcgcatctgacccggtaatgattaatgcagcgggtctggttacgttcaacactgcgggcaactacaccgttcgcatcaagttacaggcggggcgcactggagcgagcgggacgtccgtcctgttatcgcgcattcttcttaacggcgcacagtacggctcgccagcagctactaaactggtaagtgctgatactacaatcccgattgaatctcgcgtcgttattaacacaaccgcaggccagacgtttgccgttcagattatgcgggatagtgccgggaccaacttcggcggcgtatatccgcaagttgctaccgtaaccgcatggggtacagcaccatccgcattactggttatttcgagactggaggccgcctgatgaataagttcacatgtggtgtagtttttggttttcttaccgcggtagtcttgcacagttacggtgttcttttgacgctgcaagaggtgctaaaatgagcgccgctttcagtaaacgtatgcaaggcgtgggtacgcgcctgctaaccaaattcggtagcacggtatctctgattcgcgctggttcaaaagtatgggatgaagttctcggtgagtacgtctggtctgcggatgaagtgttgccgttgaaggccgttccggttccggtaaacgcgggactggtaaacggtacgacgattcaggctggcgacatgattgttaaagccgattacaacgtcgttccgaagatggaagacaaggtgcaattcggcggcgagcaatggtccatcgtagctattgagaagaagatggttaacgatgacgtcgtggcgtactttattcaggtgagaaaatgagtttcgcgctcgatgtctctaagttcgtggaaaaggcgaagaagaaccctgagaaggtgatgcgtcaggtgtctatcaagctgttttccgctattataaaggcgagtccggtagacacgggccgctttcgtatgaactggatggcatctggcggtactcctgcttccgggattacggacgctacggataaatcaggaaacacagcaaccggaaacgctacgagtttcgtgctgaaagccgctgactggcatgagttcacgctgacaaataatctgccgtatgcgcaacggctggagtatggttggtcgcaacaggcgccagccggggttgtcaggactaatgtgtctcgcttccagcaactcattaacgaagaagccaacaaggtgaaatgatgggctactttgaggacttaacaaaagcgttcgatgttccgctggtagccttcggaaccgccaacggcatcaaggtcgcgcttgaaaacatcgacgcgccgacgtcaaccgatacgccatatctggcaagttacatgttactggcggataccgagcaagcagatttgttcttcacggaacaacgcgcgggtgtttatcaggtcgacattaactacgcatcggtgaaaggtagcgcgccaatcaataaaatggcagacttacttaacacggcattcaaagcaggtaagtcattttctcgtaacgacatctgcgccgaggttcaatcggttagcctggggccgctgattgtagaaaacggatgggccaaacgaccattgtcaattaactttattgcattcaccaagaggctgtgaatatggctacaactccttttaagggcgcgaataccgcgcaattctatgtggcggaagtcaccccgggcgtaacaccgactaacccggtctggtcaccgttgcgtaacactggcggtgttcctgctatcacccgcgacacgctgacctccaacgaactggacggcagccgtgaaactacatccatccgcaccggtaacaaacaggttagcggtgaatacgcgatcgagcttagctcgaaaagccaggatgactggctggctggtgctttaggctctacgtggcaatccggtgtttccctgtccagtctgtcgattaccgtcgcaccggcgggcaagacgttcacacgcgctaccggcagttttatcactgacggagttggggtaggcgacctgattgcatttaccgatttaacaggcgataacgcaaaaccatttattgttactgcagtaacggctacggttgttactggtgcgggcatccaacacaccctgaccaccgagacaaaaactagtaaggctaaaaccggcgacacgctggaaaccggtaacacgtgtaagacgttctctatccttacctggtacaaaggccagtgcggcggtactgacgcgtacacgttaaccaaaggcgtggaagtttctggttttaccatcgaacaggctgttaacgcgatggtaactggcagcttcccattcatcggtcgcagtcaggagattctcactacgccgccgaccggttccaacttctcatctgttacttttggtgatgagccgttctcttcggttgacgtttccgtgttcgatggctctacgccgttgcgttgtgatagccttaccatcaccaacgacaacagcgcgtccgcgcagttcgaactcggcaacactaacgtggcctttgtggaacgtagccgcgcggctaacaccttctccatctccggcaagctgtacgacatggctatgattcagaagtttatcaacgagcaacaggtagagattaactctattctggcgggggtaaacggggctatgtctttcagtttgaaacgtgcagaacttacggcggttacacctgagattggaggacctgagtcaatcactcagtctattgaaggccaggctactggcaaccagtaccagtcgtctattgttatccagcgtatcacctacgcataaaactaaggccccgtttggggccttagttttttttttcttacaaacctaattttaaagcaatgtctataacgttcgatttaacgtcacccggtatgatgtaggtgtcgtaatcttttacaccatcaacgccatacagataaccacggctgtccccctcaaacgtatagccgtcacgatgaaggcgaacgattcgcacgtcatgcccgacggcgacgataggggaaacttcactggcgaatcccccgtcggacactacaaaaacttcgttgccgtcgggcaatcttccggcaagatacttaccgaaataatcgtcaccgaataccggtttaatgaattgctcagaaatggcaatcatgaactgacgccgagacaacccgttaaggaaaccctctggcttttctttccgcgcccggtcgtcgtagccgtcgagaaactcgcggtaagcatcctggcctaacgcagccatagcaatattgaacatcggattcttgaaactggcgacacccttcgcaaagcccatttctaccagcgccctagcaagtgtgtctttcccgcagcccgcaggaccattaagaataattaccttagccattatttatcactcccatgtggttttaagtgtgtagagttcccgttacagtcgtattcagtaactgcgtgagtggttatgccgagttcgcggaaatgctttattaccgctggagagtcgtcgaatgcacacaagattctctccggcccaatagcacgcaacacctcttctttaattacgatgtcttttctgttgtcgtgtttgctgcgcatgattaactgataaaattcgacgcggtggcgctgcaaccacattctggtttctttttccgcgtcatcactacggcctgttaagataataacggcatagcgacgattaagggcgttacacagttcgatgttatctttaatgggtgcatcgtctttgcacgccatgttaaatggtttccacgcccaggtttcgccgtagttatctttcggcagcaggtgtaaacgatgagtaccatctgccaatgtcccgtctaaatcgaaaatcacaatatctttcatccaagcatctccggtgaaatagttaaacgtgcgacctcgccatattcggcgctataagtaattacgtttgcactgcggcccgacatccacccaccgcgggaggcatatgcatctttagccgcgagagtgcggtgttgctcaacaatcatgttacggctttctacaatcttttggtggtgcaggtgacccacgtgggcgtagctgtaaacactctcgccgaacgctttgcggaacttggcgatcataaccggttcgatagcatcgaagcgtgctttatggccgtggtgaaagaacagcgtagttttgccgtgttgcaccatcttgtaaacatccggcgacgtatcgacgaacacacgcggctcattgtcgtacagcgtactaaacatctcagctaaccaaatcattccgctttcgtcgtggttaccttgcacgataagcaagcgaacatttttatgtttaacgagagccatatcaatgacacggcggaccatacgaatcatgtagcgtacaagtttctgatagcgggtgtcagcgtcaagaacatgaccactggcaggtgtaacggcgtccagactatcgaaatgcgcaaggtcgcccagcagattaataactcctgttccggcatccggtgctttctggaacgctgcgtcgaaccagcgggagaacaggtcttccgcaatcttcatgtcccagtcgtcgccgctctcgtcagcccaggccagcataccgagatggaaatcagacacagtgtaaaggttgagtagcttgtcgtctcgtttggcgcgaacggctttaacaggtgcaactggtgtaatctccgacttcatgccttcgattacggctttcatcaattcaacctgacgttcggcatcggtgtcggtcttaacccattgcaacttggtgttgccaaactcatccaccagtgatgacgttcctttaatcttgtagccgtccggtacaaggtaactaacgtcacgcccgtggcctacacctttcttagccagcttcgctttacggatacgaataacgcggtcggagatgccgtatttacgggcgatgtcgatattcttcataccggcgttcaattcttcctgtaactgttcgtcggttattttcttcctggccatgcttattcctcgtgtttaggatttggcctatactagctcacttctctttgacattcgagttgcacgcccagattaagataaatacccacggcagcagaatccagccaagaaacaggttagccatgaatatcgctaacttcgctttatggctacgcatatgggccactaaaaacgggataaaataaactaaaacgataataattaagaagaacatagtaatacctgtcatggtgtagttcctgtttgagttaacattgttggtgtaagtgaatagtatcctattatgttggggtgtgcaagtaatgtgttagaattattttgcgcctagtgtcgcacacgaaaagcgggtggttcccgcctggcgcattaaccttaaccagtaacctcttaaccaaaggattaaataatgaaactttctgatttttattacgaagctgaggccgaaaaaggcgcgcgtatgccgatccccctgaaagatggtacggactcaggggaatggcttaatgttgtttctcctgaggcagacgttgccgttaaggccatgcgagcatttacgctggcgtaccgggcggcgttaggcagactgaaacagcttcgtgataaatgcgaagagacgaaagatttctcggaatacaacattaagatggaagacgcagcgacggaccttaaccgccagttagcacttgaactggttaacggttggagtctcgacgatgaatttaataaagagaacttgaatactcttttctcacagtataaacgactcgccgaacacgttgttgttttccataatggacagcttcgccaattgcaggaaaagtagacgcgttgctccagttcgcccgttggaacttcataacccgccacaaacggcgggaatttgacagtattgccgatgggcataaagctgcgctaattgctatgggggttatgcaagacgcgccggaagcaacgcaggacgccgggccagaatgcccccctgagctactaaccaccttcgagaagtaccgggaaatcaaatttacccgccgagtggatgacgacggcatcaagatgtacccgcgcgaacagttacgatggtcggatttagtggcgtacagcaccgtttcaggccagaatataggcatgtttgaatctgacatcatcatgagcttagacgctattttcgagggtagaaacgatggctgatgtagctagtttagttgtaaaagtatcggagcaaggcgcgaaagctacatcagaccgtcttgataacctttccaagtccgcaaaggtagccggagctgcggtagcgggcctcgcttccatcgtcgccgctaccgcgtacaaggccgcacaggaactggtagactcccaacggcaactggacaagatgtccgccagcctgaaaacactaacaggaagcacgcagggtgcaagacaggcattaagcatcctgcaagacttcgcgcgcgacaccccgtatggtcttgaacaggcggtagaaggattccgtaaacttgtggcgcttggtcttacaccgtcagaagaagcgttgcgctcctacggcaacaccgccgctgctatgggtaaagacctgaatcagatgattgaggccgttgcagacgccagtacatttgaattcgagcgccttaaagagttcggcatcaaggccaagcagaacaaaaacgatgttgaattcacgttccagggcactactacggtggttaagaagagcgctgccgatatcgagcaatacctgctcaacattggtaacgtaaacttcgcgggtgctatggcggaccaggccaacacactcaacggcgctatagccagcgccagcgattcctggtcgcagttaaaaatgacactggctaccagccttgatgttggtgcgcttgcaggacctatccggtacattgatgatttaatccaggaacttaacgcacaggtagcatccggcgaacttgccgccgagatgcgtatgtggggtgacatcgcatcagaagtaggaagcgcgatagagatgtcgttcgatgccgcttttggtttcgtcggtgacgcgataaacggattaaatgaactttgggattttagcagtaaaagtattaccgatagcggcgaacaaacggcgacaaccatcgcggaatcagccgccgatgcgctcgatttcatcgcggaagaatttaccgcgatggagcgcttctttgaagatatggttaaaggggcgcaggacgcaggccgtttagtgaaagcggccctcactccgggggaatcggtagatgtagcaaaaaacatcaacttccaacttggtatggccctggacacccagcgagatgtagcagacctgacgcgtaaaagtttccgtgagcaggtggaggcgcagcaaaatatcatcgcgcttaaacgagcggcatacgacatagacaaagaagccgctaaggaagaagggcttagtaaatttaaggtaactggtaccggtggtgaatccgaagatgatagcaccggcgtaaaagccgctaagaaagctgcggatgctttcgagcgccagaagaaagccgccgaggatttctactatcagtcgatccatcttaatgatgacgtattccagaaaatagaagccaaccaggaacagcagttatccaagctacaagagttttacggcaatcagcttcttagcgaccagcaatacgagaacgccaaaacccagattattctggaggcggacaccgcacgtcgggaagaacttgctaagcgggagaaagaacggcaggaaaagcagcagaaaggcgacgacttcattgctcagattatgggtcagaatgccactgagcttgagcttctagacatccaggaacagcagaaactggcggtagccgataagtaccgtgagcaggggcttattagtgagacgcagtatcaggccgcgcttaacgccatcaacgagcagtacgccacgaaacgtgccgacgcaacggcaaccgcctttggtaacatggcttcaaacatcgggtctgcgttgggcgaggcttctggtgcgtataaagcattcgctatcgtacaggccactatagccacgtacaccgcagctattgaggcgtacaagtcaacggcagctatccctgtagttggcccgttcctggcccctgtagccgctgccgctgccgttggtgcaggtatggcgcaggtttccgctatccggtccgcgcgtgaacagggcggacagttatccgcagggcaggcttccaccatcgcagaacgcggtaaaccagaagttattatgccggctggcgcatctcgtgttcgcacagcacagcagatgaaagaaattatggggcaaaacgggtcttcttccggcccgtctaatgttactatcgtaaacaacacgagttctcaaatcggcaacgtatccactgagcaagatgatgagggccgtttgcgaatcatcatcgaggagcaggtggctgcctctttgcagaacagcaacagcaagattagcaaggcccgcaaagccacaagaaatgcgccggggtttaaataatgaccgacttatatttcccacgtagccttaagcctattgtgtcgaaaggttactcaatgaccagacgtaacaacgtctggagtgtcgatttagccggtggcggggtgcgtcagggccgtgacacatattacgacgtgttccctgttagcgtaaccctgattacatccgcaatggggcgacaggcgtttctgtcattccttgaaaaagtagacggcggtgcgtcaagtttctggatggcgcacgacttcggcatgggtatcgaggattatcaggtaaccattacgtcaaccatcgcggaatccaccgaagacggcattaactggacgattactttcacggcaaccgctgagaaatcgccgttccaggaccttgagaaccagtgcctgattaacaatctgccggatttgtacggttgctatggtgacgggctggggtgtttccttaaagcctacggaactgcacaatcaacgtttccacgaatttgggacccgatgcaatgagccaggaatcagtagaagcagcctatcgctgtaagctggcgtctaacccggacggcgagatggactacatcacgttgcaaatcagccacccgttgctgtcaaagacctactatcttgtgcgcgggctacaggaacttacagcaacactggaaaccggcgaaacaatcacgttcgaacccaccccgatggaggcgtcgggggccgctaacaacagtgatatggaccagacgacgacgtttactctaccggatattctcaatcaactggacgatgagatggataaaatcccgatgagcaataccgagttgccgaaatttgtcttccgccgttacgtcagcaccgacctgtcttacccggctgacggcccggtcgtgtacgagttgcaggccattaaccaggagaagggagagttttctgcggacgtcggtacacctatgctgaaccaacgaagcactggtatactgatgacacctaaagagataccgttattacgcggcctgttgaccacatgaatattaacgactacacgggcataccttacgactttcgtaaacgtaattgctggcatcacgtgcgcattgtacgggcggatgctgggttagagacaccggcgttcgacgtcacaagcccaacggcaattaatgaagcgttcgacgaaggccatcgtgacacgaaggggcttacgaaaatagataagcctgaaaacttctgtgcggtgcttatggggtatcgccgtggtggtcgtatcgtgtggcacgcaggagtatacttcgacgggatggttagccattgcgagcttgcttctcgtcaggtacggcttgacaggctggcggacctcagagacacgtacacggagattgaattttggcgataatcctgcactacacgcgaaacgctgatggcgctttcgaccgtacaaaacacgtcgggatgccgatggagtttgtcgttaaccgtatcccggacggcgtgccggtgcgcgtctacctgggcgagattggcgatgatactgatgtcaccgacgacttcgacgcgcttaaagatgaagacgctgtgtaccacattattgagggtgcgggtagcggggcgctcggtgcggttagtaaggtgtttggttttatccttaagccaatcgccaagttgtttgggttgaacatgtccgcaaacgccaactacacggcgactaacaaccagacaacatcgcctaataacagtctcacagaccgctcaaacaaaccacgcccttacgagcgctcttatgacatctgcgggactgtgcagacaatccctaacgacctgatgcagacgtataaagcgttcaactccacgggtgctttgctggagtattcgtattatgacgcggggcgtgggcatctgcatattgaggctgatggcgtaacggaaggcgacaccctgataagcgacatcacaggttcttctgttgccgtatacgcgccgtatacttccccgaacaacaccgcatcgccgcaactacaaatcggcgacgtcgttgaccagaaactctatgtgacatactccaacgacgacgttgacggtattgtgctgaaagcaccaaacgacatcggagctaacccaagctccgacggcaccgccaaacgtatttcaaacaccggctacatttatgacccgtcgggtgactctgctttttctgagtttcttagcgtcggtgatgtcgcagtgttgagcaatttcgacgttgctgatgtcactaacctgaacggctcgtttgaagttttatacgtcgacgacttcgaagtaagattagcggtaaacagtgcgtctaactgggcagcgttgaccagcgggcagacgtacacgttaacagagcgttcagatacgtttatgggcccgagcaacacctatgacgtatcccttaccgactggtattacatggtgcgcggagaagttgaccgagtacttgctaacgttgccgggcagaacggcctctacaaatacgacggcggctataatcgcaccagcgtaacggtagaactccagtaccagatgattgactctcggcgcaacccattgagcgatatttacacagtacaggctacaattaccggtaatagcacggattacgtcggtacgtctatctacgggcaattgcctactgcatcgcgtttccgcgcccgtatgcgccgtataacgaattttgataaggactataacggtacagtaagcgacgagataaccttcatcaacctgtacgggcagtcgctggacacaaccccacactacggcaaccgaactaccgtgcattgcgcacgtaaacagacgccgcgtgccgccagtatcgacaacccagaactgcgcatgattgcgaccgagatgtgctacaaatatctaggtaatggggtattcgacccagtaatgacgcctaatacacaggcggtgcagtcgctaatcagactggcgcgtgacccggcggttggtaatctggagctgacaacggcaaacatggacaagttactcgccgtgcaggaagagattgaatcttattttggcagcgaattagccgggcaattctgctacacgttcgacgactacgacacgacgatgcaggacattgttcagaccatagctgaagccgtgttctgtactgcgtaccgtaaaggcgcggacattatgctgcgtttcgaccgtccggttgcagggcctgaaatggtgttcacccaccgtagtaagacgaccggtacggagaaatggacccgcacgttcaacgattctacgacctacgatagcctgtcgttctcgtacatcgacccggatacgaacgtacaggaaacgatttatatcccggaagaactcggtgcaaatacggaggaatacgaatcaaagggcgtgcgtaactaccaacaggcatactggctggcgtggcgtcgctaccaacgcaatgtgttaagtaaagttgtcgtagagttcgaagctactgaagagggtgcgctcgccacacccggcggcgtaatcagcgtggttaaaggttcacgtattgcgccacaggacggctatgttgttgccgttaatgggcttacgctgacgctgtcacagcccattacgtttacccccggcgatgaccactccatcattcttaagaaacgcgacggctcggtgcagagtatctctgttatcaaaggaagccacgaccgcgaagtgattatgctctccgcgccggaagaagcaatctacacggggaatagcgcactaaaaactgagttttcattcggcaacgaagcaaggcataatgctcagaagatagttgtttcttcaatcgaccctggcgacgaccgcacggtcaagattactggctacaactatgacgacggattctacaaatacgacggcgtcgcgccatacggcagcggtttctccgacggattcagcaatggttttaattaaagaggactctatatgtcaagcggatgcggtgacgttttaagcctggcggatttacaaaccgccaagaaacatcagattttcgaggccgaggttatcactggcaaatccggcggtgtcgccggtggtgccgatattgattacgcgacaaatcaggttactggacagacccagaagacgttacctgccgtgttgcgtgatgctggttttaaactggcagattttgatttcacgtcaggcggtacactatccgctaacgaccgaaacaccgcagttttgtggccgtcgtcctctggcggtgacggggattggtactattggttgggtgctctaccaaaaattatcccagcgtcatcctccccgcagtccaccggtggcgtggcagatggggcgtggcagcctgtcgggtcggtcatactgcggcagcaaatatctgatgtaaacggtgcaattctgtacccagatttacatgtggcgcgatggaaggacgaatacgacccgcgcgcatggggcgccgtgggcgacggcgtaactgatgatactcaatctatttttaatgtattagcagcttcccccaacaattggattatagacggcaggggtttgacttataaagtttcccaattacctgacattagtaaatttaagaatgctgcattcgtttacgagcgcgtagccgggcaaccgcttacttatgtagctgatggcttctttaacggctcactaactaaggtgacggataccccgttctacaacgcatggacgcaggataaaactttcgtctacgaccatgttatttacgccccgtttatggcgggcgaacgacatggtgttcaaaacttacatgtagcttgggttcgctctggagacgacgggcagacttggtcaatgcctgagtggttgactccaatccatgctgactataatgctagtgtttctacgaacagagttaactaccactgcatgagcatgggtacgtgcggcaaccgattatatgcagttatagaaacccgctacttatctaatatgcggatgaagaaggcagaactttggtcacgcccaatgccgtattttagacacccaaccggcggaataactattagttctggctccactactgctaccattgttatagaaaatcatggcctaaaagcaggagatgcggttaacttctctaatacatcggcaactggcgtatcgggtaatatgacggttgcgtctataattaaccgaaatacgttcactgttacgctctcaagccctgcgagttccaccataaacaatgcgggtgttacctggaacttcgcaacgcgattctgggacagcccgtgggaaattaccgaattgccgggggtagcatactccactaacgctgatttgtgtgtcacggagacacatagttttgcggttatagatgatactaactacactatcgctgtcggctatcacaacggcgatgtgtcccctcggcgtctcggcgtcttgtattttagtaacgtgtatgacaatccaggcgtattcgttcgtcgcactgtcgctcaggcatacgctgataacgcttctgagccgtgcgtgaaaagttatggaggtgtgctctaccttaccacacgcggcacattacctacttcccctggctctacactggcgatgagcaccgattcagggcaaaactggagctacttgcgatttccgaacaatgtacatcactccaatcttccgttcgctaaagtaggtgactatctctacatctttggtacagaacgtgccttcggcgagtgggaaggtggcgagcaagacagccgctatgaaggttcgtatccacggacctttatgtgcaaagttaatgtgtcgtcatggccctcatctttagatgatgttcagtggtttaatattaccgaccaaatataccagggtcatatcgttaacactgctgtcggcgtcggctcggtctgtgttaaagatggctggttgtactatatctttggtggggaagacttcttctctccctggagcatcggggataacagtgcgaagttatggtacaagcatgatgggcatccggctgacttatatagctaccggataaagattgaaggccacccgtatgtgtcacgtgatttcaaatacggagcaactcctaaccgtacactacctgtcgcaatgggtgtagatggtgtccgtcatgtagaagcacctttgacgtttgacaatgatataagcgtgtactccctgcgtgtaacggggttggaatacgatggcacacaacagtctgccgtgcgtgcacggtttgatggtgattacgggctgatttcaaaaacagtcccgactaaaactccatcgggtcaacgactgattgttagtggcggtgatggcgcatccagttccgacggtgcattgctgcaactgtacgggtcgaaccatgcaacgcctaacagggctattatgtatgcgtcaggaggcttctactcatacgacaatttccttccttacttagactcgcaagtgtctttaggttcggcaggtaataggtggactacggtgtacgcgaccaccggtacgataaacacgtctgatggtacacttaagacgaataaagaggaaattgagggacaactccttaccgcatgggaggatatacatgtaatatcttttaagtggcttgaaagcctagcaatcaagggtgacactgcaaggatacacttcggtgtgatagcccaagatgtgcgagacatcttggtcaaccatgggcttatggagaaagattctaccgattgtaaatatgctttcttgtgctacgacccaattgaagctgcgtatgatattgatgaagatggccagactgtacaagtatcccctcccggcggcagatggggggttagggcggaccagatgttcttcatagagattgcctatcagcgtaagaagatgcgcgagttcgagaagaggctggcagcactagaagataaataaaactaaggccccaaacggggccttttctctactcttcggataacttttccagtacaaacgccagttgcgcattagcggcgtctctttgctgccgtagtcgcagaacctcttcttctagttccttgatacgtttttgcaatgctggaatcggggctatgatgttcatttcttacctcttctcttcatataattaagcaattcttcctggaccgatttcttctcgtctgtacgcgcggcaacaacctcgtcaagagtgtctttagcgactatgtgataaaggaacaccgggcgctcgtggccagcctgtttctggcggaccgggcctatacgctcgacaacctgcaaatagtgctcaagattccagccttgcgaaataaacgccagatgatgcccgccgtcctgtaaattcaaaccatgcccggctgacgccgggtgcacgcataagatttcgatttcgccacggttccacgcttccatctgcttattacccttcgcacctttggcgaacgcctgcgcctgcgggaatcgcttaaggatgcgctccagttcatgcttaaactgataagccacaagtaacggtgcgccctgtaactcctcgacaatggactcgagcgcatccagtttcgtatcgtgcactttctcccagtctttcgttgcctcaccgtccggccctgacacatatacggcgccggatgcaatctgcaaacactttgacgtcttcgctgcggcgttagccgcttctacttccccgctctccagttccgcgaataacttctcctccatatcgatgtacgcctggcgtgctttcttcggcaggtctatttcaaccggtacgataatcggcgcttcgcaaccgaaccactcggcagcgtcaatcgtgagactaatgtctttcatcttctgatgaatttcattatctgcacccggtcgcgcatgatactctcgcgccatcgccgacttacctttctggacagagttaaaccatcggtcggtgaatgccgtgtatgaagaaccgaggcgctcgcctgcgtcgataaaccagttctgaccccacaagtctttgaggccgttcggtgacggcgtaccagtaaggttgatgaaacgcttaaccttaccgaatgccactttactaagcgcctttgcccgcttgctgccacctgaacggctacggaaagatttcagtttcgtgctttcatcggcaacaataaccgtaaaaggccagtcgtctttgccgtagtagtcaatcagccactcgataacttcgtagttagtgcacaccacgttagcatctgactccagcgccgcgatgcggcgtttctctgaacctgtcgcatctacgacacgcaggcacgggaatcgccatttctcttgttctgccggccatgtacctgatgcaacgcgcaacggggcgagaattaacacgcggtcgtcgtccgtaagttgcccgttgcggaacaggcggtttaaagtccacaggacgctgccagtcttcccggcgcccatgctcgcccaaatattacagcgatggtgctgcaacatgaacgaggtcatgagcttctggtattcgcgcctttgaaacttactcatttacggcccccataaacgcctttataaattcggcggctacttgcgggacgatggcattgccgtaaccgcgcaatcgtcccactctggcgggtatcccattagccagcgggaatgcgccgggttcaaccggccggaactttccatcacggcatccgagccagtcagcatctgaccagaagccgtggtgcgggttggttgactcgctttcaatccctgctctgttgagtagtccagcctgtcgaatgttctgtccctcccgtccgtgcgaatcactgtctctccactccctctgaagtcgttcgctgtcggtgtaggccagttcgtgcgcgccaaagaagagtcgttctcttttgtgcggtgcgccgacgctacaagctgggagtacagcaaacccgacggcgtagtcttctccttccaggtgagcttgtaaatcgcacatccacgattttgcaattgctgccgcaacctgctccccaaagatgactggagggcggcactcgctgatgaggtcgaggaagaccggcgcgaggtgtctcgggtcgaactgtccgagttgctttcccgccgcgctaaacggttggcaaggcgggcttcccgtccagagaggcgcatcttccggaactcccgcaagtctgagcgcgagaggccagccgccgatacccgcgaaaaaatgacactgggtgaacccgtcaaggtcttctggcttaacttcggtaatgcttctttcatctacaactccaaaaggtatgtgaccctgttttatcaactcacgcagccacgcggctgcgcctttatcccattcattgtaatagttcatttcgccaccagaactaactctttacgcccgaacgccgtaacgttaccggttacatcttcgataaccagtttaccgttcgactcgacgaacaccgtatcaacggcaacaggttgacgtgtcttaacgttgaaaatcatgtcacccggtacgatgtcacgtgctggtttgcggtcatattcgtgtttcatttctcaattccttatattgttggtgtatgactaactataatagttcgctattaggtcgtcaacctgtttaaacgaaccaacgacaaaaacattcgcaccacgtttacgcatacgctcgtgctcacgtaactggtgtgggtctggcttcgtgttttcgtctttcttaacctcgacgaacaagacgatgccgccgggtagaattaccagcaggtcgggagcgccggagcgcccctcataggaaagtttacgaacgaggccgccgatagcctcgaatcgctcttttgcgtatttctggatgcgcccctctttagtcatgggcgcagaatccaggtaatgaaagccccacctagaacggcgacaccgacaaacttaaagaacaggccgtaacagaacatcgcggctattcccgcaccgagtaacagcgcgagcatggttactatcgtccaaaatacaaacattgtcataatacgcacccctcacgtttcgtatgttcaataccgcagcgcgggcagattcgacagtcttcttcataaaaccagtaaattttcattccagcacccacagataaattgcgatgaacatgcccaatatggcaaccatcatgccgtattgaccctcgtgacagtaaacaccggcggcgaatccagccagtaccgcgataatcagtttacttggcataacgcttcatctccgcgccttctgctacaagagggaacccctcggcccactctggtaattcgcacatcaatcgttccagttctgcgacattgtattctggtaaatctggtgtctcgcagataatctcatcgtgaacatgaagcacaatcgggtagccgtttgcttcgacgttcagcagtgcattagccagcaaatcacggcacagcgcctgagtgcagttttccaccagtttaccagagtaggtgtactggaagccccactgacgggttaactggttttcgccctggtacttgatgcgcacgttggtagacaccctcccgtcttcgtctgtctctttcgacacgcttagcccaacacccggataagacataacgcggcccgacggcaacgtcatccgcaaccaccaaccggcgactttgttgccgttgttgtccgtttctacgttgcgcgaaaacttaactccccgcggccctgcggtgaactctttgcccggattgcggatagctgccatagctgcgtcttcaatatcccgccagaaagctactgtttccgggtgtgactcacgccacatacgcttgatagcgtcgcaggtacgccacactttcttatcaagaatataagatggtcggtcatcattttcacctggacgtggtggtcgcttggcttcctgaatacgcgcccactcatatccacgtgcggtagcagcccagatgtggtcagggaaagtcccgtccattgtttttgccatatcaacaaggtcaaggccgaggttcttggcgaactgtacgaatgcgccgacaccacccgcgtagccaagtccaagttcacatgccttaccaatctggcgtaagtctttacgttctttcttaatgtaatccggctccatgccgaacatcttgcctgcggttacgcagtaaatatccagcccggcacggaacgtatcaagcgcggtttcttcgccagccagccacgccaaaccgcggccttcaacgttcgagtagtcggcgacgacaaacttatgtccggcttccgggataatgcagctgcgaaccgtagatgccgttagcttggctacatcaaaacggcgatgtgctcggcccttaagtaatgctgaaatacctttatccagttcatcatcgtgatagtacccacgcgccaggttctgcggctggaagcctttaccagcaaatcgtaacgtacgtttagctccaccatactggatgcaaccgcgacggcggtcgtcagacgagcggcctaacagcagcgggttatatttcgttgacgcagtggatgccaccccgaggcgcatttctataatcgtgcgggcgtcgtccggtaaatcatcgtcagcaagcaggtcgttaagcgtagacttctgcgcgttgtggatgcgatgcgcaggcgccagttcacgcagaatcggcaggaagtccttacctgtaagcgagccgccgtatttacgtcgggcttcttcctgtaactgtgccttgtgtttctccacagcttcaattgcggcttccgccagcgcaacgtcgaccttaaacccgcggtcgttaattaactggtccagttccagtacacggtcttcgaactcggagttaccccaacgcggcaacttatggaacacttcacgcatcgcggtgatgtcgctaacggcgtacttgatgaacagcgcccactcatccgggtgcgtttcagcagtgtagcggcgaattttgtagttcttcggcgtcggtttagagaaacgctgaataagcgctttgcctcgtttgtctttcgcgttgtctgcagacacgccaagcacttcgcacaatgcgtcgagtgaacccggcagcgcgtgacgaaacgcccaaatcatcgtatcaatggtgttgcttacgggaatatcaaaaccccagcagtgcttcatgatgagtctgtcgaacattgagccgttgtgccacaccatcttaatacggctgtttggtttcaccagacggcgtaacgcgcggtgcaaatcacccggcatgtcgccgccgttggtgcaatcccatacctgtacaggctcgtcgtcaaaagcataggtacagataagcacttcggtagtctggtgttcggcataagcgtaggaaccgactttctttaaatcggctttggagaatgtttcaaagtccaggtataaatagctcatttctttttccttaaatccagtgccttcgttttgctgagtcttattttcatacaatcacggcaaatccacacatgcctgtacccggcgcggtactcatccgcgtaccacggaagtggcttcatatatcggtatacgtgcttacagaaaaacattattttcgacccttagtaaaaaggcccaatgaagggccttagttaaattgattcagttattaacggcgacgacgttcgcggcgcggtgcttcatcttcttcgtcgtcttccaggtcgttgacgcttgcagcgactttagaaccaccgaacgctttaccttcgcctacgtatttaatcgccagcaggttaaccccgagaactttatatttctggctgaaccagatttcgacgcttacgttagcgacgcagccgctgtaaacctgttcaccttcaatctgttcgccgtctacattgaagtcctgttctacctgagtctcgccttttttagaggttacaatcagtggctgtttctgtgccttcgctttgaagtagaagccttccgggaagtcttcaaacggattgtcacgctcggcaatgtctttaatcgcgcatttatccatgtgctttccttcgccgtagttggacttcatccacttctctgcggcggctgcgcctaacgcttcttcaactacagcgtaaacagtgtcgtagagcgcatcgatttgagcatggtcagacggcaagatgatagtcgcgctgtactggcctttagtgatcgagccatcatcgttttcacggtctttttcgcgttcgaatacgttaacccaagcagtgtttactttacgcagatttaatttaatacccatcttaatttctcgcttttcagtttactccgggaagctgcccggccagtgattagaactataatagctaactattcaggtgtcaaccctttattccaaatcttcttcactaacccgattccactcaggccgtttatcgtccaccgttgcaacacatggcgcacctggcttacgggtaataaacggctcaagcgctgccatctcatccgcagaaagaacttttgctgcctccgtaggggacatcaatacctcttttttgagaatgtcgccgtgtgacacttcaatcgcatcggcatctttccacgcacgattacccgggcgaccttctaccagtttgtaccctggcactttcttaccggaatgcaatgcggcggacatcgctttctcaaccttgtcgatgtgctggcgtaacagcggcaacttctcatactcaactacgagttgctccgtcgtcagttccagcacaaagtcgtcttcaagttcttccgccagtacagaattaaccgtctttgtacgcgcggcacactgttcagagaaccggcaccactggcaaccatcgaccgacggtttaaagtccgacgctttcaggttcttctttccacggaaataagcatcaagcgctaacagtgcccgtttctgtgcgaacttagcgaacagttccagaccttcgaccgagatatcccactccgacgcacaccccgcgtacggctggaagatgaccaggcgcactactgtgatgttataacgtctcttgagtcggcgataaacaccgagagcgtaaagcataagctgcttgttttctttcgcttcgacgcgatgccgtcctgttttcaggtcaccaataatgagcatgtgctcgtcggtgtttgccagttcctgtacggcaacaaggtcagcagttccgaacgtttcaacgccttcgtagcctgggtgcaacacctcagtaagattgacgcgcatttccagcttagcgtaagtcgctacgtcgataatcgctttgcagtagtcggtgtacttgcgcacctgctcaatcatgtccgccgtaatcagtaccgcgcctttcattgggctgattagcgccttaatctggcctttaccttcatccagcacgtaagcgccgacttcacgctctaatggcagagcagtgcctttgatgtactggttaaggtgcatctccgctatggtgtggcatgcagtccctgtaacggcggctttaccagacgtgttgggaatatctttctcacaggccagtgatgcactgcacgccagccactttttagcgccagacggcgacagtaaggcgtgcacatcgttattgccgccgcgttcctttaaaatcataccctgctctcccactggtcaattaaatgtcgtgtctggtgatggcaatgcatggcccacccgtacatcgactcgaagacataaaagtcaggtttggcgaaagtcgtgcgcttaatctgcgacacgtgacggcctatatctttaggccgtggtactttgcctaagtacgccatctcttccatctggtgcgagccagacggcgcacgtaacagccatagcgcctctgtgctatcccgcctgtctacggcgcggtagagttggtaaatcataattccgaccctcagttaaagcggcccgaaggccgcgggatagttattcttcttcgaaatacttgttcttgattgctgtcaggcgttccaggtattcagccaggtcttcgtctttaatcgcagcaatcttcatcttcttaccggtaaactcttccagcagttcgtcagaatcgtcgcacgcggcatcgcttgggccttcgttaatcgcatcgtcgatagcctgaatctggtcacgaagagactggtagtcgacttcttctttctcttctttctcttcttccggctctggcgttggttcctctactttagctttacgcggcttgcgtttgggcttctcttcttctgccggtttagtgtcaacgacgtcttcaccttctaccgggatttctttcgttacttctttcacaacagtaggctctattgttgcagtttcggcaacgacaacttgtttcgcactgttcgcagcaatcagttcatgtgcaactacgaaacgttccagtaatactaagaatttctctaacattatttattctcctctcgtttggtatgggctaactataatagtgaactattcacttgtcaatgggcttttctaaaataattaatatggtactattcacatatcaactgactaaggagtaattgacatgctaccatctgaactaagcatccgcgtagaacagcgccgtaaagaactcggcatctcccagcgccgtctggcgatcctcaccggcgtttcccagggcgctattaaccagcttgcgcttggggtgactcaggacgtccgcccggcgacgctgtttaaactggcggaagtgctggaagtagacgccaagtggctggcgttcggtgaaggggcttaacgcccctttctttttacctattccaaatcttcctcagtaaccactagcatttcattcggttcgtatattgtcttcggccttaatctatccactattctttcaggtatacgatatgttctcggtactacttcgccattaacatcgcagcctagcattagttcgccatctttcagcattttatcaagatgggtgttagtcacagaaaagtcaccggaacgggccactatctgctgctgggtaaaaccgcgacctgtatcatctgactgttgcaggtcttccagtgctgaaagtattgactccttccttacttcatccctgccgcggttaactttttcctttactttttgtttaccttcgttagttaacccttcttcccgctctttctcctcgtcagttttgaacggctcgaagccccacggcatcagaacaagcgccttgtgtggttccggcaggtcgaggtttacgattgtgccgtattcctctgtgctaccgaggaactccaccgcgcggtactctttcgctggcggtgcttcgcggaactgtaccgactcaagcaccattccaaccgttttctgttgggggccgtgcttaaatttcgagtggtatacgtttatctgacggtcggttgcacgttcgattgtcagttccacgtcgacacccgcatacagcgccccgctgccacgggctttctttccccccttcggtgtatggtgaacaacgcccaccgcggctttggttgcgtcgcgtacttctttcagtatggcgataactttacccatgccgattgtcgtcgacgaactgttctcgtcgaacttatcaatcgtcagggccagcgtctggttaagggtgtcgaatgcgaccataccaataggctcgccgttggcggtttcgcgcatcctgcggattagcgcgggaatttttttatcaccatgcgccgtgagtacctcacccatgtcgatgacatgcacataatctttaccttccctgccatatttagccgcgagtgcgtcaatacgtgtgcgtgtagctgcgccaccttcaccgtcgatatagaaatggtggcaacgctgggtgtctgcccccgcaaaccggtacccggcggcgctaaggtacatcacccccagcgtatagaatgatttatatgtgccggattccccgacgatgtcccagatgcaatccgatggcatgtacccttcaacgacgaaatcagcctttaccggttcaggtaactcgtcatcgtcttcaaggtcttccagtgtacaagttacaggctcctcgttctctgtgcggtgcagttcttcaatctcttcatccggtaaatcaggcagagccgcacgaatgctgttaatactgataggttgcttgtctacgttaagctcgtccggaaggccgcacatacgcagggccaaatgttgtcggcggttaagctcagtgcaagcgccgttgtttgtgtgctggcacacgaagcgcacctctttaccgtcaagcatgatgctggtggagcctttgcctgtatgcagatgttcattagggcatggcacttcataccctcggccggaagataaagcgtcaaggcccagctcggcttcgcagaaatgagctatatctgcgttaagcccgtgctcatcggcggcaagtgtcttagcctcgcgtttacgcagccccatctcttcggctttcttgatgtaccgctccgcacggataacacgcccttctgtaaccgttatcttagactctttatgtggcaggtagatgaggcggttgccgtcttccgtgcagtggtcgcgcagcgattcatctatttctaactcggcacaaatagcacgttgcaccatccacgcgtcgttagagttaaacggagtgcgagccggtacgaggacgcggaaagcgtaatcaccgtttttacacgcgtgctgatgtgacgccgttgtgtgcagaatattgaagaacggtgcgttcttgaatttgcgggtaaggtcgcggtactgagtacggttgagatggtcgaagtcaaacttaaccacactgtcttccagaatcgcgttcttacggcgaccgccaaccggcgcaatagctttctgcttaatcttggccgcgtcgtactcttccttagtccatgacgggtctacggacagacgcttcgatgtatcgcagacatactctacaaactgctccagtggcatttcacgggctaccgggtttttatcgaatgtgttacgcagcgttgcaaaaacaatattcatttctttttctccgcacgttctaaggcttcctgcatacggcgcattgcgcggttcatctttaccggtgcgaagaaatcagcgccatgtttctggcggcgtagctgtggaactattaactttgtcattgtataatccttgtgcttactttgatgatttgtactttagccccgacgttctggcgttggggtttcttttatttatcgcccgcaaaccacgcgtgcgcagaatcatagaaacgacatttacttaacacgtctactggcatcttaataatgcgtgtaggttccgacaaatgattaggcttacatatttctgcatagaatccgctgtcagtaatttctgacgcaaacttaaaccagtatttaactttaccgttttcaaagtaacaacccatacgtccaatcatttcacgttctccttaatccatgcttcaactttattacggtcaaatgtacctggtaaacggcgacccataaccttaatacaacaatcagggaatttaccactgcgcaaccagttattaattgtctgacgtgttaccccaatacgctcggctacttcattctgtgtcatgtaatgttgcatttctatatctcctgtttgtttggtgaagctgagtataggatagcgggaatgtaaaagcaaccaatccctgcaatatttaatctttacaaaaaagttattgaaagttcttgacacatgtttgtataatggttttgggacttgtatatattacggagttgacgaaccctccccgagggattcgtcaacccctcccagacagctgagatgcttgttttagggtttaaggataagtgtatctaaatctcatttaaagaagtaacccactgaaatatctactgtttcttaatgtgccgtagattcgcaaccgtaaaaatgtaacgattattgggcaggcttaaggcctaccctttagttaccaagtaataagaataaaggcacaaccttccctaaagaatcacaacggcaacgtaactaatctcttgcacaccccaacataataggatactattcacttatcgaaacgagacagaggagtgagggttatgtttaaacgtggtcagttggttaaatactccgacgataaacacggcataattgaattaaaatctgctttatttccaggaaagtacgtagttaccgtgcaaaatgtgagaggagtaaattcacaaatatacgtagcggaggagaacttaaaactcatcggcaacaattttaaatttaaagggtgaagtgatggaagaattatttgaagaactgaaacatcatgatttcgaggaaatatatttcgtagctgaacgctacgaggtgcatctggcggacggtataacggttattacatctaccagcgagcgaatgttaaatagcttacgagcaatacgaacggcatcgaatcatgatgcttgtgccgacgacgctgagggaggttgccgttaatgcgaatccgtataactgaccgcaggcttgtccgtataactgaccgcaggcttgtccgtataactgaccgcaggcttatagatttcggtatctcggtaggtgatgtttttccggcgttcagcatcaaccattatggttttatgattgagtacaaagggtcgttattgttcgtgtatcgggatgaatgtgaggttctggtatgagagaagcatttgaacggtgggctgtggtcgagggtctgccggttaacaagggttcaaagaaagagtacctgaacgttaagacgcgtctcgcgtggcgggcgtggaaagctggtgtgcaatccttgattgaaagaggtgtgaggtatgggtgagtggattaagtgtagtgagatgctgccgggtaatgggtatacggataaagagttcctggtgtatgaaacgttaaataacgcagttcagcacgactattacatagttcctgatgacgggagaaagcctttctggaatcactacgataagtacgtgacgcactggatgccgttacccgagccgccagaagtgtgatgttcaatagtttgggattttactgagtgacttacgctgctacacagcagcgtacaactttaacttagtgtcgtcaaaaggcgacactttcatcaaacgcaacaatctaagcggctattgcaggagatgcaacaatgattactaaagaacaggctgaacgactaatcacgttaatcgacacgatggttgatgctaaaaccgatttagcaacggcgacagaggaatccgctacctggtcgcttgaagaaagagaggcagaagcggaaagggagttactggcgttcatcgactctgtaacacaccaataaaatttacttgcacactaagatagaataggctactattcatttacacaaacgagaggggagacagaatatgaaagattatagcgaagtaactttaggtgagttgcaggacgagtacgaagatatgcgctacccgttcatctgcgacggggactacaacggcgtctataacggggtgagcgaagaatatgaacactaaaaacgaaatattcgagtacctgatcgaccagctacggcagcaggtaaataacagccggagcgaagacctggcgcatgaggtgcagtcacttaagaatcagttacgtgatgcgtcagaacatattaaggagttgcataaggcgttggctacagctacaggtgacataggcgcttatatagcagcagagcaatctggttgccgtaaggaagatactcagtacaacgcctggaggccgcattatggtgcacgacaacctgtgccggatgggactatggtatttatccggtatcgcaacggggtggagccgaaacacagtgtagcagcagaaaagcggtcgtggatttgggatggaacatacgcagacatagtggaatacaagattgacacacaggaatgtgaacatgactatcgtttggttctgtggtgtagcgacttacagcagtgctctaaatgcggggtgatcaaatgaccagcatattatttatctgggtactgtccgcgggccagatgcaactcacggcatcagaaacgttttattcgatggaggcgtgccagtctgcggcacgcgccgcagagaacgcacacttcctgtttcagggcgacaagcccaacgattcagaggtacgcgctatctgctcacctaagcgacttggtaaacaggagaaataatgtcgttagcaactgacatcctgaaacgaagcggccttgcgccgctgtcgccgagagctaaaacacagatatacaagcgccgccgtaatgcgctgtacccggagattcagaccagacgcaaagctatccgcgcctgtggattccagaacgggaaggccgtgaatctcggtgagttcaagacaaaggaacgcgccgctatcgctaataggctatttaattactggaaatcgctggggtacgatgatattccaacgaaaccgcagagacgacaatacatatggagacacaaataaaccgttattaggataattcctacccgtggtatcctccagttactgcatacttaatacgcacccggaggattcatcttggataaatttactgaaacagtgacggggtggcttctcgctgccgcactggtcggaggggttataggactacgacaacataagtccgttatctccggccctatcgacggcttctgctttattgcaacgggcttcaccagcgccgtatttggcgcacctcttgcggctcaatggtttggtattaccggtgagcgcgagatagctggcctcggattcatcattgccattctctggatgcctatctattcccgcctttctggcatcgtatcgggcggcgatattgcccgcccaggaggaccgcatgactgagttattctggtttgtcgtaatgctggcaatgggcgcttcgtccctgttcaacgtgtataatgaacgcgtggacgacgggctgttcgggcgtgttctctatatcctgactgctatcgtctgtgccgccggatgtattcacctgttacagggcagcatgtcgcctacgctgcctgagacattaatcacattagtcgcgctgcgccagattcgccaggcgtggctgtcatacggagggcataagcgtgtctcgaaatatttcagataatggattgcatttctgcgccgcgttcgagggattccgcggaactgcgtatcgcgctacgccgaacgagaagtacctgactattggttatggtcactacgggccagacgtaacaccaggtaagaccatcacaccaggacaaggcctcctgttactgaatcgcgatatggctaaggccgtagctgcggtcgatgcagcagcacaccattcgctgacacaggcacagttcgacgctgtgtgtgacctggtgtataacgcaggtgctggcgtgattgcgtctactacgggcacaggcaaggcactgcgttctggtgctattacgacgctgcgggctaagctggcgctgttcatcaaccagaacggcaaaccgttacttggcctgcgtcgccgtaccgcaggacgtctggcattgttcgacggtaaaccgtggcaggaggctgaggcaatcgggcgtgcggtgaaaggttgacacctaagactaatccgacgatacttaaatcacctcctgttccatccctctgctctccagttttatcccggccctgacccagccgggattttttttatctatcttccgcaatgactagttgactattactctcacaccaattatatttactccatcgacaacgagaacggagtagagaagatgaaaatcacagataccgaagcattcaaagatgcgcaactgatggcacgcatcgccgttagtaacctgagcaacagcattcctgcggacgcgttctggttcgccgcgatgcagacactgaaagcagcttatgcaggagagaagaaatgagcgaacaaggtcagataagccaaccgttacgcgtaggtcgtaaagtaagtcacactccgttcccgacacgcgaggaactgatgaaacgtaacagtttccctgggccggacaagaacaagtatctcaatcgcatgtggggagagaagaaatgactgaccgtgaatacgaaaagatgatggtagaggctgttaacggcggcgtagacatcggtcacgtgatgcacgtcctgaatactaaaatcgcagtagctgagcagatggttgagtcgctttacgggacacgccgtgaactgattaaccgcttcaacctgaacaagggtgataccaatgcctaaaatcacaatcgcatcactcgaacgccgtattatggtgctcgagtcagagaaacagacgttaggcgggcaactgtcgattaacggtgagtaccagttagccgcatttaaggttcttctcatgttgttgagaggagaagaggaaaagatgaacgcctgcgagcatgattaccgcctgcatttagttgatggggtgcatcgagccacatgcttaaaatgcggtaaagcgtatggagtcgcctaaaccagtagtaattgatggtgtcctgtggaaaccctactcggttaaccatatcgacgccgacgggaagaagtttagtttctacatttttgcaattagccgtgagcacgccgcctgtgtggtcgacgatatacgagaaacggcggggcttggtgatgagatagtggggtgattatgttcagtgacattaacgcggcaatcgaagaagcaatctggcgtcgttacaacggcgagcaacaacggcacttttgcctggtgcaacgcggtaacatggttgccgtagtgcaggaccgcgataacaaatatccgaatgcgatgtggacaacgaggaatttcttaggatgattaccagcattccaaacctgattaaagaatacggcacgatggctgagacatgccgacaaaccggcatcaacgaaatgacgattgccaagtacagcaaagacgttaactgcgagcgccatgtaatttataacaaccgtctgatgacgcacgttaagacaagcccggtgttattcacgcgcaggggtatcactaaaactgagcaacgtattgctaaagaggagagcggggaatgattagtattctggagttcatcgacaaccaagtttggtacgagccagagttaaataagtattcagttaatgggaaaatatttcggcgcaaaggccaggcggagcgttacgcagctaaactataccgtcagcttgtcaaggatggtttcttcaaatgagactactaatcatccctaacgcccgggccattcccgtagctaacgaccattacggcggcgacggtaaaagagcaccacgccacgacctatacaactgatacaagccctctaccgagggcttttctgtacatcctgcccaatcaccttatataatccctttagacgcgtagggcgcgtctgatgcgctctgatggtcagacgcatatgcaaggggattctatgaagctgaaactcaagcagccatcgccagaggtggtgcaagctgcacatgaagaagctgttagtgcaaaccgccgccgtaaacgaccgcgcggtaaacagagcctttatcaatcatcccgtaattccgccgcgttgtgggacccggactattgtgacgagttaatccggttcttcgaccgcacgtcatgggaggcaatgcctaccggggcacacggagacatgaaagccgttatcgcggataaacccccatcgctggcccgcttcgccttacacatcggcatcactatcccgattattaagctgtggctgcgcgaggttcctgcattcgctgaagcatgggaaacggcgcaggcgctggaagaggcctatttcactgagacaggagccgctggcatctctgctacgtttgctgccgctaagctgggccttagcaaagagaaaccagttgaatcgaccgaagaaacagcacctaccgagattattttcagtgttgcagagcctgtaggtaaaatcgtaacaacgaacatgggcgaggtagagga
